US010695415B2

(12) United States Patent
Wu et al.

(10) Patent No.: US 10,695,415 B2
(45) Date of Patent: Jun. 30, 2020

(54) LIVE ATTENUATED ORAL VACCINE AGAINST SHIGELLOSIS AND TYPHOID FEVER

(71) Applicant: Protein Potential, LLC, Rockville, MD (US)

(72) Inventors: Yun Wu, Rockville, MD (US); Dennis J. Kopecko, Silver Spring, MD (US); B. Kim Lee Sim, Gaithersburg, MD (US); Stephen L. Hoffman, Gaithersburg, MD (US)

(73) Assignee: Protein Potential, LLC, Rockville, MD (US)

( * ) Notice: Subject to any disclaimer, the term of this patent is extended or adjusted under 35 U.S.C. 154(b) by 0 days.

(21) Appl. No.: 15/742,459

(22) PCT Filed: Jul. 6, 2016

(86) PCT No.: PCT/US2016/041192
§ 371 (c)(1),
(2) Date: Jan. 5, 2018

(87) PCT Pub. No.: WO2017/007852
PCT Pub. Date: Jan. 12, 2017

(65) Prior Publication Data
US 2018/0264099 A1 Sep. 20, 2018

Related U.S. Application Data

(60) Provisional application No. 62/189,083, filed on Jul. 6, 2015.

(51) Int. Cl.
A61K 39/116 (2006.01)
A61K 39/02 (2006.01)
A61K 39/112 (2006.01)
A61K 39/00 (2006.01)

(52) U.S. Cl.
CPC ...... A61K 39/0283 (2013.01); A61K 39/0275 (2013.01); A61K 39/116 (2013.01); A61K 2039/522 (2013.01); A61K 2039/523 (2013.01); A61K 2039/543 (2013.01); A61K 2039/70 (2013.01); Y02A 50/476 (2018.01); Y02A 50/484 (2018.01)

(58) Field of Classification Search
CPC ............ A61K 39/116; A61K 2039/522; A61K 39/00; A61K 39/0275; A61K 39/0011; A61K 2039/6037
See application file for complete search history.

(56) References Cited

U.S. PATENT DOCUMENTS 7,541,043 B2  6/2009   Kopecko et al.
8,071,084 B2  12/2011  Kopecko et al.
8,119,365 B2  2/2012   Blattner et al.
8,337,832 B2  12/2012  Kopecko et al.
8,992,943 B2  3/2015   Kopecko et al.
9,284,566 B2  3/2016   Liao et al.
9,580,718 B2  2/2017   Curtiss et al.
2005/0281841 A1  12/2005  Kopecko et al.
2007/0054358 A1  3/2007   Blattner et al.
2013/0288325 A1  10/2013  Liao et al.

FOREIGN PATENT DOCUMENTS

WO   WO 2014/043637       3/2014
WO   WO 2015/021147 A1   2/2015

OTHER PUBLICATIONS

Lodish et al., Mol. Cell Biol., 3rd ed. Scientific American Books, NY, 1995 (Year: 1995).*
Hoppner, Horm Re. 2002, 58 Suppl. 3:7-15 (Year: 2002).*
Dharmasena, M.N., et al., "Development of an Acid-Resistant Salmonella Typhi Ty21a Attenuated Vector for Improvement Oral Vaccine Delivery," PLOS One: e0163511, Public Library of Science, United States (2016).
Lu, P., et al., "Supplementary information; L-glutamine provides acid resistance for Escherichia coli through enzymatic release of ammonia," Cell Research 23(5):1-11, Nature Publishing Group, United Kingdom (2013).
Lund, P., et al., "Coping with low pH: molecular strategies in neutralophilic bacteria," FEMS Microbiology Reviews 38(6):1091-1125, Oxford Academic, United Kingdom (2014).
Martinic, M., et al., "Contribution of the Lipopolysaccharide to Resistance of Shingella flexneri 2a to Extreme Acidity," PLOS One 6(1):e25557, Public Library of Science United States (2011).
Bryce, J., et al., "WHO estimates of the causes of death in children," Lancet 365(9465):1147-1152 (2005).
Bardhan, P., et al., "Decrease in shigellosis-related deaths without Shigella spp.-specific interventions, Asia," Emerging Infectious Diseases 16(11): 1718-23 (2010).
Livio, S., et al., "Shigella Isolates From the Global Enteric Multicenter Study Inform Vaccine Development," Clin Infect Dis 59(7):933-941 (2014).
Scallan, E., et al., "Foodborne illness acquired in the United States—major pathogens," Emerg Infect Dis 17(1):7-15 (2011).
Bowen, A., et al., "Notes from the Field: Outbreaks of Shigella sonnei Infection with Decreased Susceptibility to Azithromycin Among Men Who Have Sex with Men—Chicago and Metropolitan Minneapolis-St. Paul, 2014," MMWR Morb Mortal Wkly Rep 64(21): 597-598 (2015).

(Continued)

Primary Examiner — Gary B Nickol
Assistant Examiner — Lakia J Jackson-Tongue
(74) Attorney, Agent, or Firm — Sterne, Kessler, Goldstein & Fox, P.L.L.C.

(57) ABSTRACT

Disclosed is the attenuated Salmonella typhi vaccine Ty21a utilized as a vector for Shigella and/or enterotoxogenic E. coli genes stably integrated in the Ty21a chromosome. These genes include a heterologous Shigella sonnei O-antigen biosynthetic gene region that comprises the wzz gene and expresses Shigella sonnei form 1 O-antigen, as well as a heterologous acid resistance biosynthetic gene system comprising a YbaS gene, which enables increased stability of the Ty21a vector at pH 2.5 relative to Ty21a without the integrated acid resistance biosynthetic gene system.

Figure 1A:
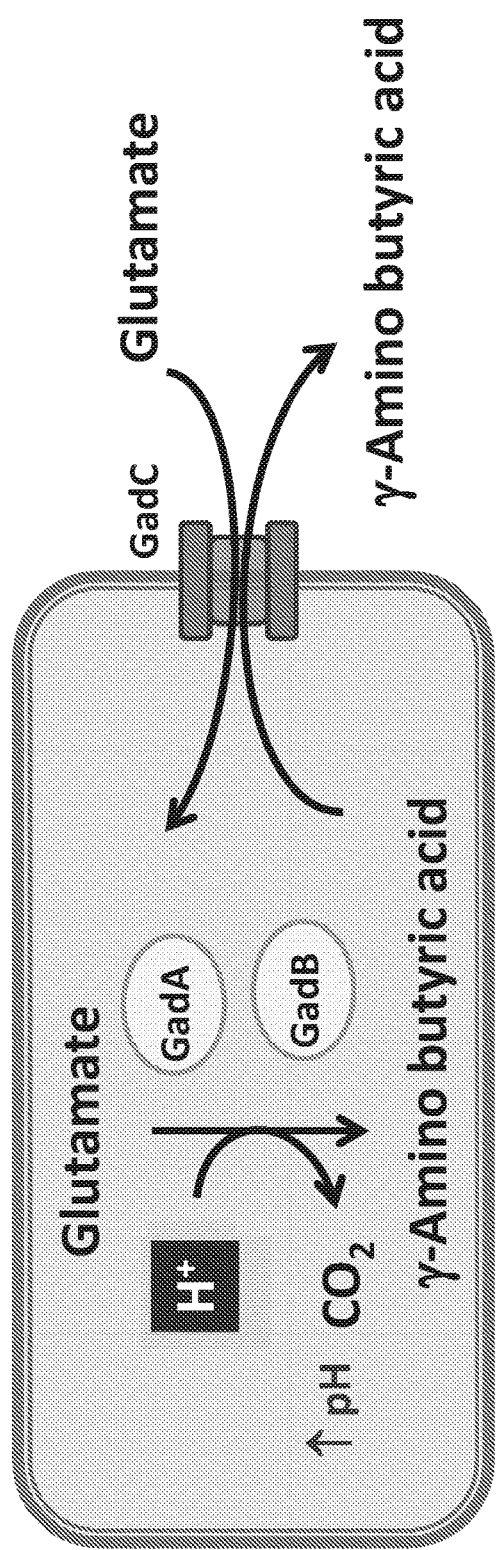

12 Claims, 14 Drawing Sheets
Specification includes a Sequence Listing.

(56) References Cited

OTHER PUBLICATIONS

Howie, R.L., et al., "Reduced azithromycin susceptibility in *Shigella sonnei*, United States," *Microb Drug Resist* 16(4): 245-248 (2010).
Karlsson, M.S., et al., "Outbreak of infections caused by *Shigella sonnei* with reduced susceptibility to azithromycin in the United States," Antimicrob Agents and Chemother 57(3):1559-1560 (2013).
Gu, B., et al., "Comparison of the prevalence and changing resistance to nalidixic acid and ciprofloxacin of *Shigella* between Europe-America and Asia-Africa from 1998 to 2009," *Int J Antimicrob Agents* 40(1): 9-17 (2012).
Robbins, J..B., et al., "Hypothesis for vaccine development: protective immunity to enteric diseases caused by nontyphoidal *salmonellae* and shigellae may be conferred by serum IgG antibodies to the O-specific polysaccharide of their lipopolysaccharides," *Clin Infect Dis* 15(2): 346-361 (1992).
Kopecko, D.J., et al., "Genetic stability of vaccine strain *Salmonella* Typhi Ty21a over 25 years," *Int J Med Microbiol* 299(4): 233-246 (2009).
Levine, M.M., Typhoid fever vaccines, in Vaccines, S.A. Plotkin and W.A. Orenstein, Editors., W.B. Saunders: Philadelphia. 781-814 (1999).
Levine, M.M., et al., "Duration of efficacy of Ty21a, attenuated *Salmonella typhi* live oral vaccine," *Vaccine* 17 Suppl2: S22-7 (1999).
Wahdan, M.H., et al., "A controlled field trial of live *Salmonella typhi* strain Ty 21a oral vaccine against typhoid: three-year results," *J Infect Dis* 145(3): 292-5 (1982).
Gilman, R.H., et al., "Evaluation of a UDP-glucose-4-epimeraseless mutant of *Salmonella tvphi* as a liver oral vaccine," *J Infect Dis* 136(6): 717-23 (1977).
Cryz, S.J., Jr., "Post-marketing experience with live oral Ty21a vaccine," *Lancet* 341(8836): 49-50 (1993).
Simanjuntak, C.H., et al., "Oral immunisation against typhoid fever in Indonesia withTy2la vaccine," *Lancet* 338(8774): 1055-1059 (1991).
Levine, M.M., et al., "The efficacy of attenuated *Salmonella typhi* oral vaccine strain TY21A evaluated in controlled field trials," Development of vaccines and drugs against diarrhea: 11th Nobel Conference, Stockholm, 1985, in 11th Noble Conference, J. Holmgren, A. Lindberg, and R Mollby, Editors, Studentlitteratur, Lund, Sweden. Stockholrn. 90-101 (1986).
Ohtake, S., et al., "Room temperature stabilization of oral, live attenuated *Salmonella enterica* serovar Typhi-vectored vaccines," *Vaccine* 29(15): 2761-2771 (2011).
Dharmasena, M.N., et al., "Stable expression of *Shigella sonnei* form I O-polysaccharide genes recombineered into the chromosome of live *Salmonella* oral vaccine vector Ty21a," Int J Med Microbiol 303(3): 105-113 (2013).
Pickett, T.E., et al., "In vivo characterization of the murine intranasal model for assessing the immunogenicity of attenuated *Salmonella enterica* serovar Typhi strains as live mucosal vaccines and as live vectors," *Infect Immun* 68(1):205-213 (2000).
Lin, J., et al., "Comparative analysis of extreme acid survival in *Salmonella typhimurium*, *Shigella flexneri*, and *Escherichia coli*," *J Bacteriol* 177 (14):4097-4104 (1995).
Audia, J.P., et al., "Breaking through the acid barrier: an orchestrated response to proton stress by enteric bacteria," Int J Med Microbiol 291(2):97-106 (2001).
Foster, J.W., "*Salmonella* acid shock proteins are required for the adaptive acid tolerance response," *J Bacteriol* 173(21): 6896-6902 (1991).
Foster, J.W., "The acid tolerance response of *Salmonella typhimurium* involves transient synthesis of key acid shock proteins," *J Bacteriol* 175(7):1981-1987 (1993).
Foster, J.W., "Low pH adaptation and the acid tolerance response of *Salmonella typhimurium*," *Crit Rev Microbiol* 21(4):215-237 (1995).

Robbe-Saule, V. and F. Norel, "The rpoS mutant allele of *Salmonella typhi* Ty2 is identical to that of the live typhoid vaccine Ty21a," *FEMS Microbiol Lett* 170(1):141-143 (1999).
Germanier, R. and E. Fuer, "Isolation and characterization of Gal E mutant Ty 21a of *Salmonella typhi*: a candidate strain for a live, oral typhoid vaccine," *J Infect Dis* 131(5): 553-558 (1975).
Hone, D.M., et al., "Adaptive acid tolerance response by *Salmonella typhi* and candidate live oral typhoid vaccine strains," *Vaccine* 12(10):895-898 (1994).
Kantele, A, et al., "Comparison of the human immune response to live oral, killed oral or killed parenteral *Salmonella typhi* TY21A vaccines," *Microb Pathog* 10(2):117-26 (1991).
Waterman, S.R. and P.L. Small, "Identification of the promoter regions and sigma(s) dependent regulation of the gadA and gadBC genes associated with glutamate-dependent acid resistance in *Shigella. flexneri*," *FEMS Microbiol Lett* 225(1):155-160 (2003).
Bhagwat, A.A. and M. Bhagwat, "Comparative analysis of transcriptional regulatory elements of glutamate-dependent acid-resistance systems of *Shigella flexneri* and *Escherichia coli* 0157:H7," *FEMS Microbiol Lett* 234(1):139-147 (2004).
Lin, J., et al., "Mechanisms of acid resistance in enterohemorrhagic *Escherichia coli.*," *Appl Environ Microbiol* 62(9): 3094-3100 (1996).
Brenneman, K.E., et al., "Low-pH rescue of acid-sensitive *Salmonella enterica* Serovar Typhi Strains by a Rhamnose-regulated arginine decarboxylase system," *J Bacteriol* 195(13):3062-3072 (2013).
De Biase, D. and E. Pennacchietti, "Glutamate decarboxylase-dependent acid resistance in orally acquired bacteria: function, distribution and biomedical implications of the gadBC operon," *Mol Microbiol* 86(4): 770-786 (2012).
Merrell, D.S. and A. Camilli, "Acid tolerance of gastrointestinal pathogens," *Curr Opin Microbiol* 5(1):51-55 (2002).
Zhao, B. and W.A. Houry, "Acid stress response in enteropathogenic gammaproteobacteria: an aptitude for survival," *Biochem Cell Biol* 88(2):301-314 (2010).
Hersh, B.M., et al., "A glutamate-dependent acid resistance gene in *Escherichia coli*," *J Bacteriol* 178(13):3978-3981 (1996).
Smith, D.K., et al., "*Escherichia coli* has two homologous glutamate decarboxylase genes that map to distinct loci," *J Bacteriol* 174(18): 5820-5826 (1992).
Lu, P., et al., "L-glutamine provides acid resistance for *Escherichia coli* through enzymatic release of ammonia," *Cell Res* 23(5): 635-644 (2013).
Ma, D., et al., "Structure and mechanism of a glutamate-GABA antiporter," *Nature* 483(7391):632-636 (2012).
Kopecko, D.J., et al., "Genetic and physical evidence for plasmid control of *Shigella sonnei* form I cell surface antigen," *Infect Immun* 29(1):207-14 (1980).
Datsenko, K.A. and B.L. Wanner, "One-step inactivation of chromosomal genes in *Escherichia coli* K-12 using PCR products," *Proc Natl Acad Sci USA* 97(12): 6640-6645 (2000).
Cherepanov, P. P. and W. Wackernagel, "Gene disruption in *Escherichia coli*: Tc$^R$ and Km$^R$ cassettes with the option of Flp-catalyzed excision of the antibiotic-resistance determinant," *Gene* 158(1): 9-14 (1995).
Rice, E.W., et al., "Rapid glutamate decarboxylase assay for detection of *Escherichia coli*," *Appl Environ Microbiol* 59(12): 4347-4349 (1993).
Xu, D.Q., et al., "Molecular cloning and characterization of genes for *Shigella sonnei* form I O polysaccharide: proposed biosynthetic pathway and stable expression in a live *salmonella* vaccine vector," *Infect Immun* 70(8): 4414-4423 (2002).
Shepherd, J.G., et al., "Comparison of O-antigen gene clusters of *Escherichia coli* (*Shigella*) sonnei and *Plesiomonas•shigellojdes* O17: sonnei gained its current plasmid-borne O-antigen genes from *P. shigelloides* in a recent event," *Infect Irnmun* 68(10): 6056-6061 (2000).
Vivotif [package insert—USA]. Crucell Switzerland LTD; Sep. 2013, accessed at https://wayback.archive-it.org/7993/20170406143500/https://www.fda.gov/downloads/BiologicsBloodVaccines/Vaccines/ApprovedProducts/UCM142807.pdf.

(56) References Cited

OTHER PUBLICATIONS

Batzer, M.A., et al., "Enhanced evolutionary PCR using oligonucleotides with inosine at the 3'-terminus," *Nucleic Acid Res* 19(18):5081 (1991).
Karlin, S. and S.F. Altschul, "Applications and statistics for multiple high-scoring segments in molecular sequences," *Proc Natl Acad Sci USA* 90(12):5873-5877 (1993).
Ohtsuka, E., et al., "An alternative approach to deoxyoligonucleotides as hybridization probes by insertion of deoxyinosine at ambiguous codon positions," *J Biol Chem* 260(5):2605-2608 (1985).
Rossolini, G.M., et al., "Use of deoxyinosine-containing primers vs degenerate primers for polymerase chain reaction based on ambiguous sequence information," *Mol Cell Probes* 8(2):91-98 (1994).
National Enteric Disease Surveillance: Shigella Annual Report, 2012, "Human surveillance Data: Laboratory-based Enteric Disease Surveillance (LEDS)," accessed at http://www.cdc.gov/ncezid/dfwed/PDFs/shigella-annual-report-2012-508c.pdf accessed on Apr. 2014, 9 pages.

* cited by examiner

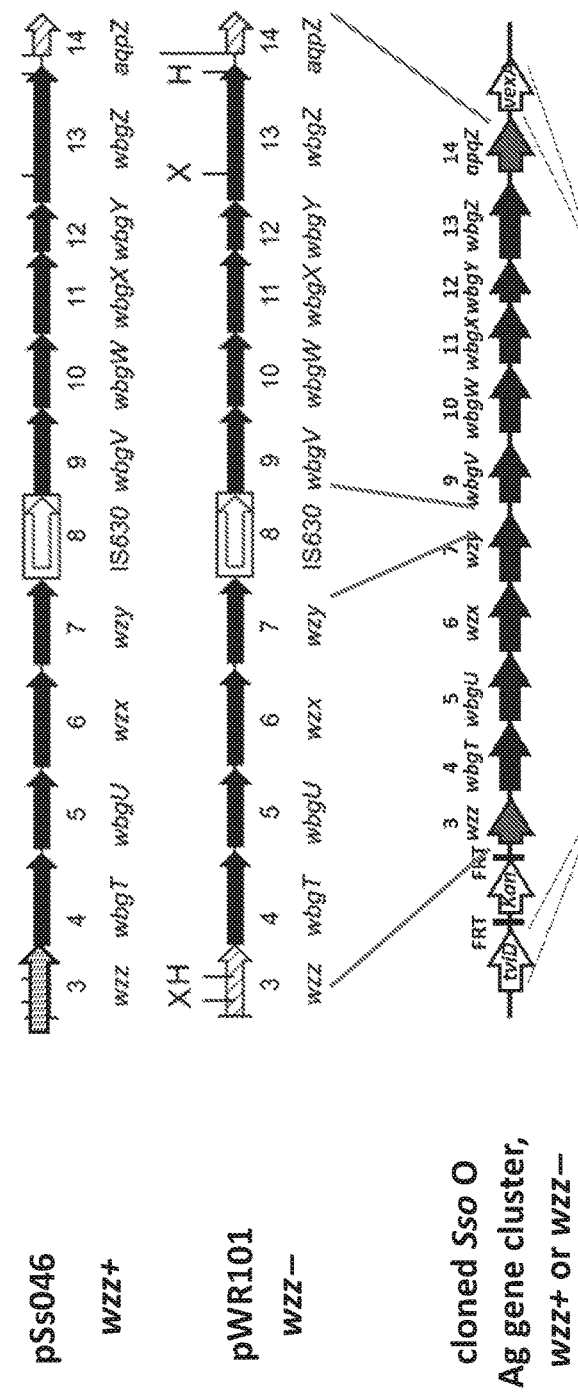
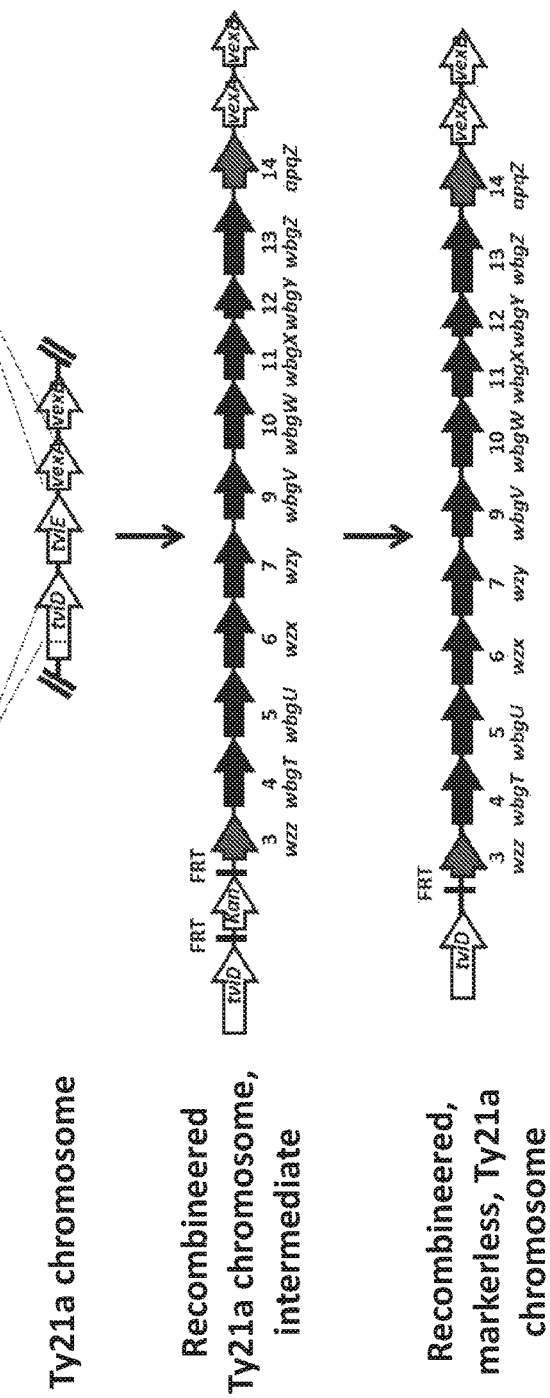
FIG. 2A
FIG. 2B
FIG. 2C

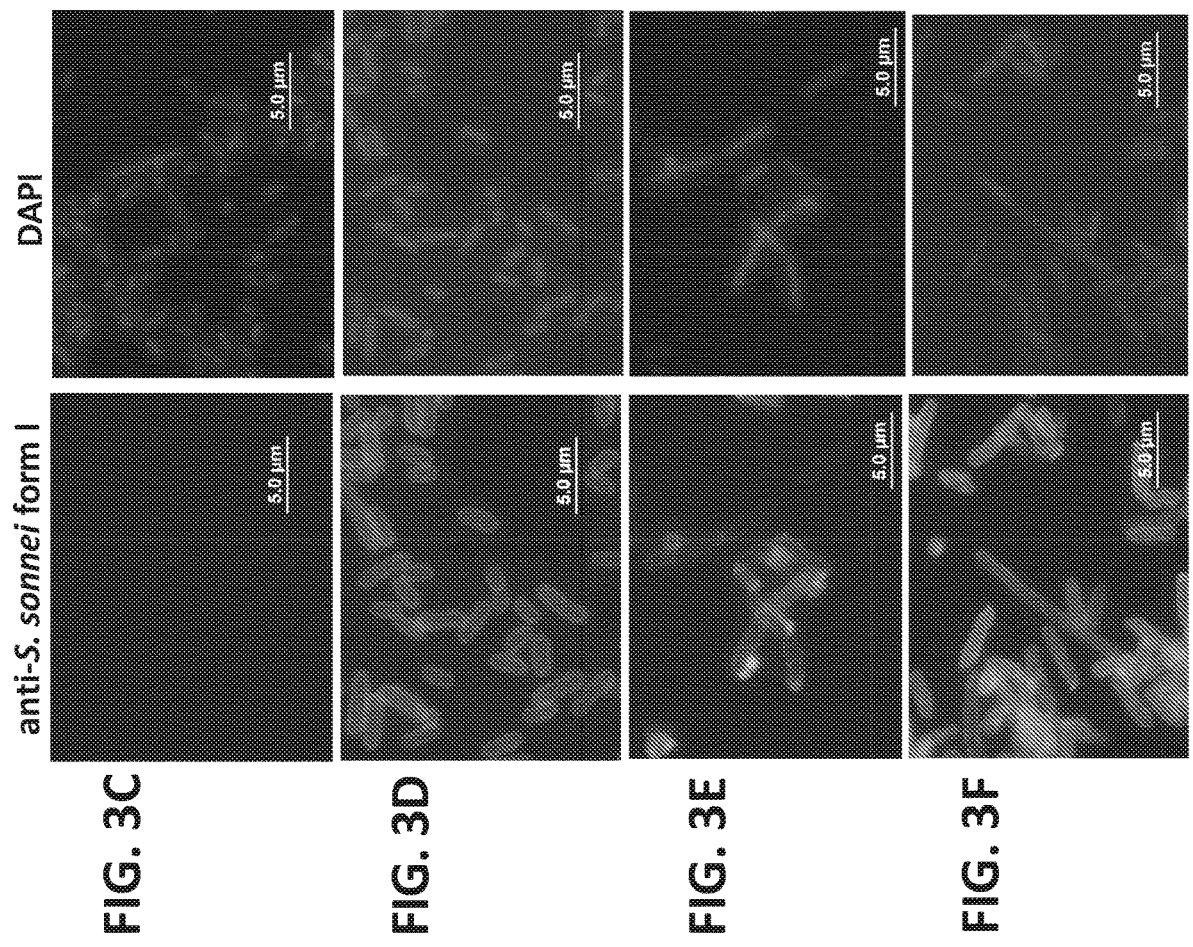
FIG. 3C
FIG. 3D
FIG. 3E
FIG. 3F
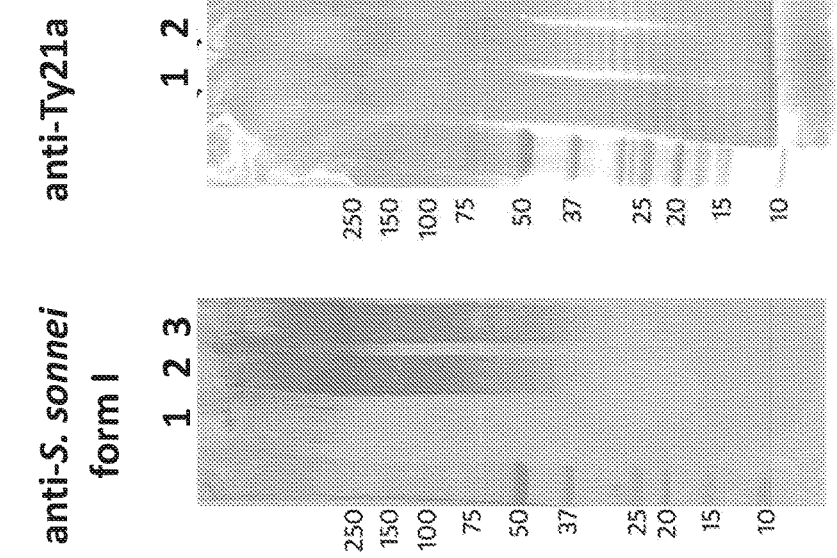
FIG. 3A
FIG. 3B

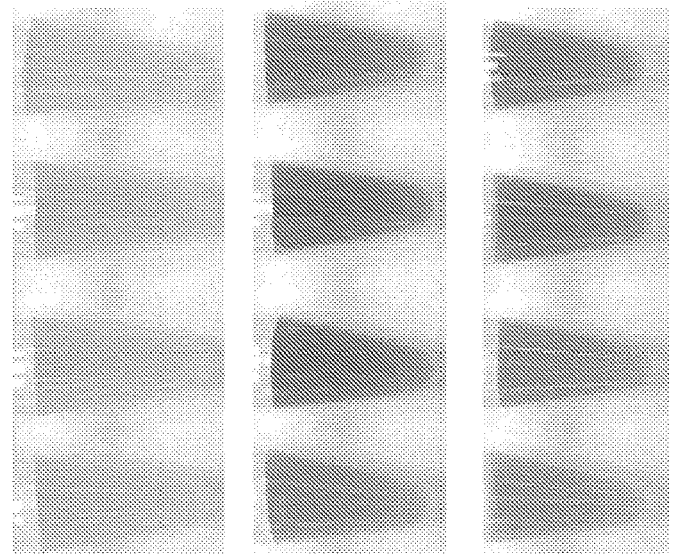
FIG. 4A Ty21a
FIG. 4B S. sonnei
FIG. 4C Ty21a-ABC (clone #2-2)

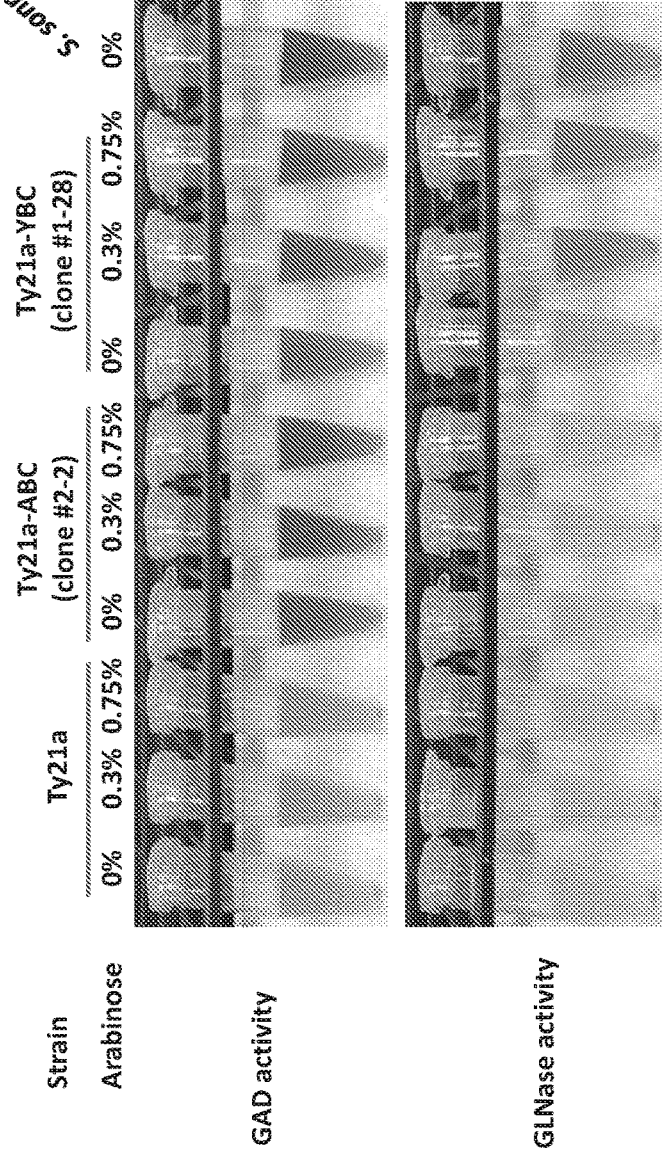
FIG. 5A GAD activity
FIG. 5B GLNase activity

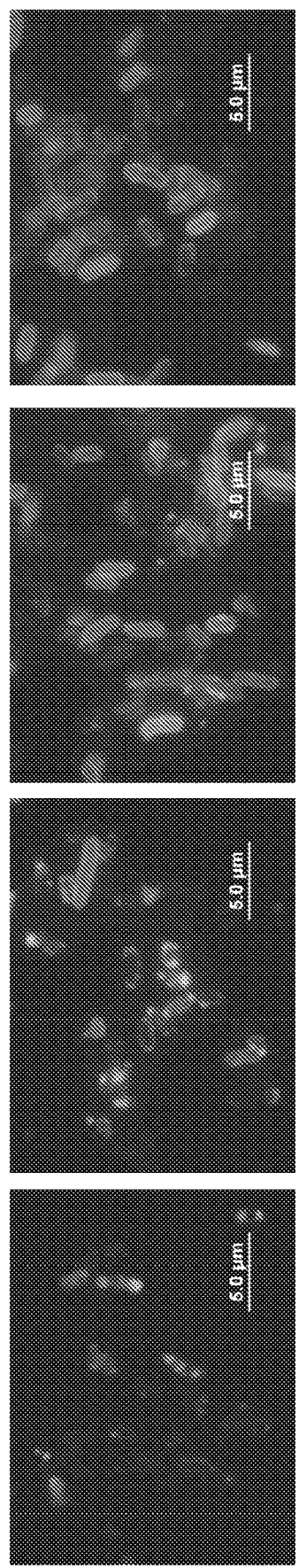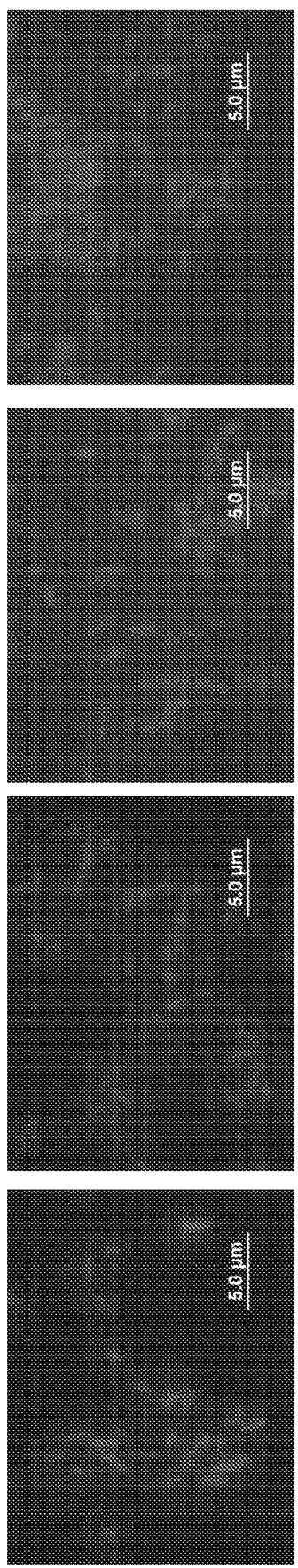
FIG. 6

LIVE ATTENUATED ORAL VACCINE AGAINST SHIGELLOSIS AND TYPHOID FEVER

CROSS REFERENCE TO RELATED APPLICATIONS

This application claims priority to U.S. Provisional Appl. No. 62/189,083, filed Jul. 6, 2015, the contents of which are hereby incorporated by reference their entirety.

STATEMENT OF GOVERNMENT INTEREST

All strains disclosed herein were constructed without government support. However, characterization of strains was supported in part by SBIR grant R43AI106158, "Live Attenuated Oral Typhoid-Shigellosis Vaccine".

REFERENCE TO A SEQUENCE LISTING

The instant application contains a Sequence Listing, which is submitted in ASCII format via EFS-Web and is hereby incorporated by reference in its entirety. This ASCII copy, created on Jan. 4, 2018, is named 2602.0160001_SequenceListing_ST25.txt" and is 37,461,284 bytes in size, and was originally submitted in International Appl. No. PCT/US2016/041192.

BACKGROUND OF THE INVENTION

Recent retrospective analyses indicate that the global burden of *Shigella* infections is >125 million annually [1, 2]. Shigellosis affects mainly children and causes at least 250,000 deaths per year. There are more than 40 serotypes of *Shigella*, but only a few are responsible for the majority of shigellosis. In developing countries, *S. flexineri* accounts for most of the case isolates in children under age 5, while *S. sonnei* is the second leading causative species, at about 24% [3]. In developed countries, *S. sonnei* is the leading cause of shigellosis. In United States alone, CDC estimates that there are about 500,000 cases every year; of which 75% are caused by *S. sonnei*. (reviewed in [4] and CDC, National Enteric Disease Surveillance: *Shigella* Annual Report, 2012.

In recent years, incidents of drug-resistant *S. sonnei* infection associated with international travellers and adult males who have sex with men have been increasingly reported [5-8]. *Shigella* is listed by both NIAID and DOD as a high priority pathogen.

Vaccines comprise a rational and cost-effective means for protecting against infectious diseases. Protection against shigellosis is believed to be based mainly on anti-O polysaccharide (or O antigen) antibodies [9].

*Salmonella Typhi* Ty21a typhoid vaccine (Vivotif®) [10] is the only live, oral, attenuated bacterial vaccine licensed in the US. Ty21a, when administered for a one week period, affords sustained protection from typhoid fever for 7 years with efficacies ranging from 62-96% as reported in Chilean/Egyptian field trials [11-13], and it has had an unrivaled safety record during the past 25 years [14-17]. There has never been a reported case of bacteremic dissemination of Ty21a after administration to more than 200 million recipients [10], and Ty21a is nonpathogenic even when given at 100 times the standard dose [12]. Also, there are no reports of post-vaccination inflammatory arthritis (e.g., Reiter's syndrome) with Ty21a, a potential problem with other live attenuated vectors including nontyphoid *Salmonella*, *Shigella*, and *Yersinia*. In addition, Ty21a can be foam-dried, which provides for temperature stabilization and a potential shelf life of 5-10 years [18].

Dr. Kopecko's lab used Ty21a as a vector to express *S. sonnei* form I O-antigen from an expression cassette inserted into plasmids (U.S. Pat. Nos. 7,541,043; 8,071,084; 8,337,832; and 8,992,943). Additionally, a recombinant Ty21a strain carrying a genome-integrated *S. sonnei* form I O-antigen gene cluster constructed in Dr. Kopecko's Lab induced high levels of serum antibodies against both *S. sonnei* form I O-antigen and *Salmonella* O9, 12 O-antigen and protected against lethal challenge of *S. sonnei* in mice [19 and WO2014/04367]. However, the immunization and infection route was by intraperitoneal (IP) injection, which is not the route for Ty21a immunization per se, nor is it the natural *S. Typhi* or *S. sonnei* route of infection. LPS alone immunized through the mucosal route is not immunogenic [20]. Moreover, high serum IgG does not directly reflect the strength of local mucosal immune responses.

Curtiss et al. described a bacterial recombinant comprising a Gad B/C acid resistance cassette [49].

There is a need for bivalent and multivalent transgenic attenuated, acid resistant vaccines for protection against shigellosis and typhoid fever.

SUMMARY OF THE INVENTION

This application is related generally to bioengineering, and to multivalent oral vaccines for protection against shigellosis and typhoid fever.

The present invention relates to the development of a bivalent, oral, live attenuated, acid stable composition (e.g., a vaccine) for use against shigellosis caused by *Shigella sonnei* and typhoid fever caused by *Salmonella enterica serovar typhi* (referred to herein as *S. typhi* or *Salmonella typhi*). Disclosed herein is the characterization of the constructed vaccine strains, e.g., Ty21a-YBC-Sso (clone #34-1) administered through immunization routes, including, e.g., oral administration. This invention discloses the preparation and use of the attenuated *Salmonella enterica serovar typhi* vaccine Ty21a as an expression vector for *Shigella sonnei* genes stably integrated into the Ty21a chromosome. Also disclosed herein is a Ty21a strain co-expressing the concerted YbaS-GadBC AR system and *S. sonnei* form I O antigen and the characterization of such vaccine strain.

In an embodiment, a transgenic *Salmonella typhi* Ty21a is disclosed, comprising a heterologous *Shigella sonnei* O-antigen biosynthetic gene region and further comprising a heterologous acid resistance biosynthetic gene system, said biosynthetic O-antigen gene region and said acid resistance biosynthetic gene system both being integrated into the *Salmonella typhi* Ty21a chromosome, wherein:
 a. heterologous *Shigella sonnei* form 1 O-antigen is stably expressed;
 b. heterologous *Shigella sonnei* acid resistance enzymes, comprising a YbaS gene, are stably expressed;
 c. said transgenic *Salmonella typhi* Ty21a is more stable at pH 2.5 than *Salmonella typhi* Ty21a without the inserted acid resistance biosynthetic gene system;
 d. immune response and/or immune protection is elicited against virulent *Shigella sonnei* challenge; and/or
 e. immune response and/or immune protection is elicited against virulent *Salmonella typhi* challenge.

In an embodiment, the heterologous *Shigella sonnei* O-antigen biosynthetic gene region of the transgenic Ty21a comprises a wzz gene. In some embodiments, the wzz gene of the invention is derived from the wzz gene having Gene bank accession: NC_007385.1 (193411 . . . 194517). In some embodiments, the wzz gene comprises a DNA sequence that shares at least 90% sequence identity with the DNA sequence of nucleic acids 4,511,904 to 4,513,010 of SEQ ID NO: 4 or a complementary sequence thereof; the DNA sequence of nucleic acids 4,511,904 to 4,513,010 of SEQ ID NO: 4 or a complementary sequence thereof; or a DNA sequence that encodes a functional variant of the polypeptide encoded by the DNA sequence of nucleic acids 4,511,904 to 4,513,010 of SEQ ID NO: 4 or a complementary sequence thereof.

In an embodiment, the heterologous *Shigella sonnei* O-antigen biosynthetic gene region of the transgenic Ty21a comprises a DNA sequence that shares at least 90% sequence identity with the DNA sequence of nucleic acids 4,500,076 to 4,513,461 of SEQ ID NO: 4 or a complementary sequence thereof; the DNA sequence of nucleic acids 4,500,076 to 4,513,461 of SEQ ID NO: 4 or a complementary sequence thereof; or a DNA sequence that encodes a functional variant of the polypeptide encoded by the DNA sequence of nucleic acids 4,500,076 to 4,513,461 of SEQ ID NO: 4 or a complementary sequence thereof.

In an embodiment, the transgenic Ty21a heterologous acid resistance biosynthetic gene system comprises a YbaS gene. In some embodiments, the YbaS gene of the invention is derived from the YbaS gene having Genebank accession: NC_007384 (REGION: 504891 . . . 505823). In some embodiments, the YbaS gene comprises a DNA sequence that shares at least 90% sequence identity with the DNA sequence of nucleic acids 4,503,240 to 4,504,172 of SEQ ID NO: 1 or a complementary sequence thereof; the DNA sequence of nucleic acids 4,503,240 to 4,504,172 of SEQ ID NO: 1 or a complementary sequence thereof; or a DNA sequence that encodes a functional variant of the polypeptide encoded by the DNA sequence of nucleic acids 4,503,240 to 4,504,172 of SEQ ID NO: 1 or a complementary sequence thereof.

In an embodiment, the transgenic Ty21a comprises a nucleic acid insert comprising AraC-YbaS-GadBC-Sso O Ag wzz+. In some embodiments, the AraC-YbaS-GadBC-Sso O Ag wzz+ insert comprises a DNA sequence that shares at least 90% sequence identity with the DNA sequence of nucleic acids 4,500,075-4,518,404 of SEQ ID NO:6 or a complementary sequence thereof; the DNA sequence of nucleic acids 4,500,075-4,518,404 of SEQ ID NO:6 or a complementary sequence thereof; or a DNA sequence that encodes a functional variant of the polypeptide encoded by the DNA sequence of nucleic acids 4,500,075-4,518,404 of SEQ ID NO:6 or a complementary sequence thereof.

In an embodiment, the transgenic Ty21a additionally comprises an O-antigen biosynthetic gene region from a bacterial strain selected from the group consisting of: *Shigella dysenteriae*, *Shigella flexneri*, *Shigella boydii*, *Escherichia coli*, *Salmonela enterica* serovars, *Vibrio cholera* serotypes, *Enterobacter* species, *Yersinia* species, *Pseudomonas* species, and a combination thereof.

Certain embodiments are directed to compositions, e.g., bacterial compositions, comprising a transgenic Ty21a disclosed herein in combination with a carrier that renders the construct suitable for pharmaceutical use.

Certain embodiments are directed to a vaccine suitable for oral administration comprising a transgenic Ty21a disclosed herein in combination with a carrier.

In certain embodiments, administration of a vaccine or composition of the invention to a human population reduces the incidence of shigellosis in that human population subsequently exposed to pathogenic *Shigella sonnei*.

In certain embodiments, administration of a vaccine or composition of the invention to a human population reduces the incidence of typhoid fever in that human population subsequently exposed to pathogenic *S. typhi*.

In certain embodiments, administration of a vaccine or composition of the invention to a human population reduces the incidence of both shigellosis and typhoid fever in that human population subsequently exposed to both pathogenic *Shigella sonnei* and/or pathogenic *S. typhi*.

In certain embodiments, a method of treating, preventing, or reducing the incidence of shigellosis in a human subject is disclosed, e.g., comprising oral administration of one or more doses of a vaccine or composition of the invention.

In certain embodiments, a method of treating, preventing, or reducing the incidence of typhoid fever in a human subject is disclosed, e.g., comprising oral administration of one or more doses of a vaccine or composition of the invention.

In certain embodiments, a method of treating, preventing, or reducing the incidence of both shigellosis and typhoid fever in a human subject is disclosed, e.g., comprising oral administration of one or more doses of a vaccine or composition of the invention.

In some embodiments, the doses are prophylactic.

BRIEF DESCRIPTION OF THE DRAWINGS/FIGURES

Figure 1B:
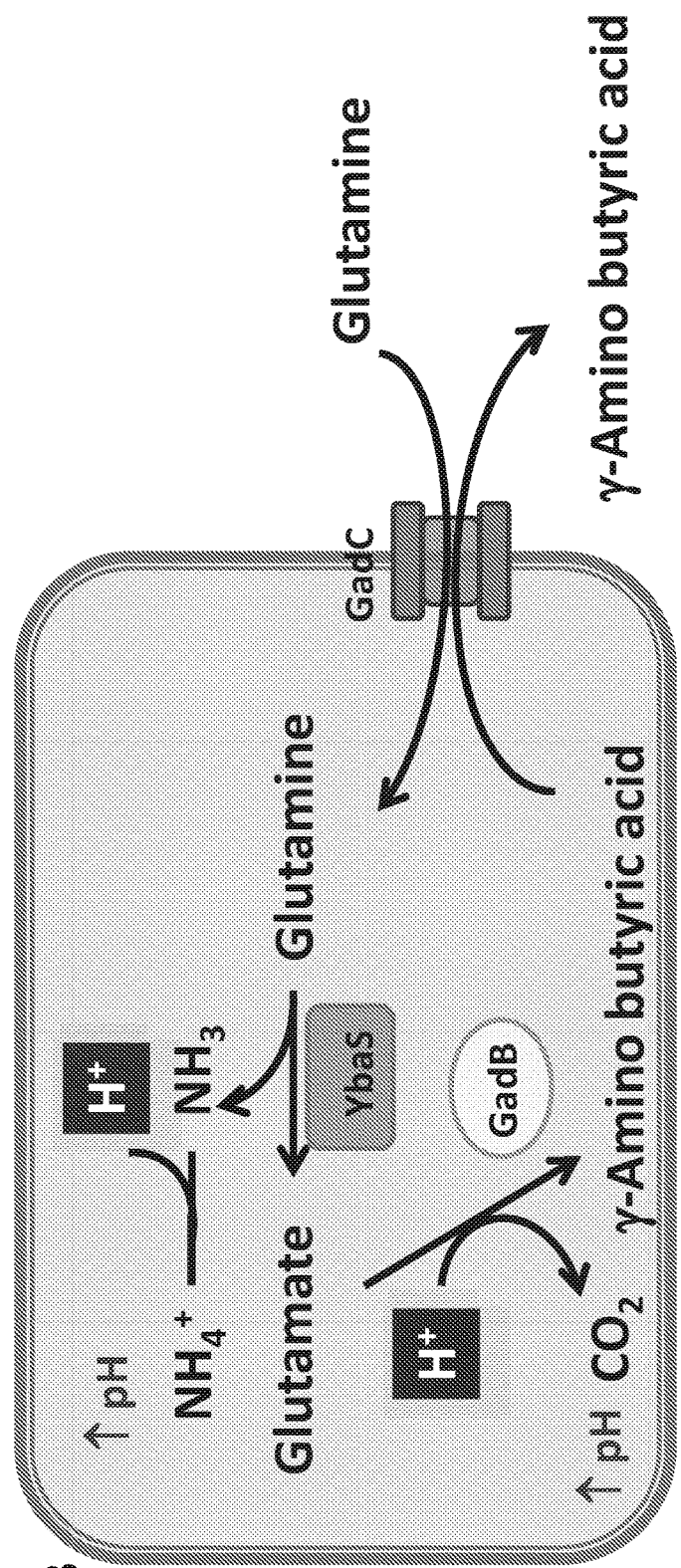

FIGS. 1A-1B. Schematic illustration of the glutamate-dependent acid resistant pathway (FIG. 1A) and glutamine-dependent acid resistant pathway (FIG. 1B).

FIGS. 2A-2C. Construction of Ty21a-Sso and Ty21a-Sso wzz+. Molecular organizations of the *S. sonnei* form I O antigen gene cluster on pSso046 and pWR101 adapted from [46] (FIG. 2A). Schematic illustration of stable integration of the cloned *S. sonnei* form I O antigen gene cluster, with or without wzz (FIG. 2B), into Ty21a chromosome (FIG. 2C) adapted from [19].

FIGS. 3A-3F. Expression of form I O-antigen in Ty21a-Sso (clone #3-1) and Ty21a-Sso (clone #9-26). LPS was extracted from equivalent amounts of Ty21a (1), Ty21a-Sso (clone #3-1) (2), and Ty21a-Sso (clone #9-26) (3), resolved on a 4-20% Tris-glycine SDS-PAGE gel, transferred to a PVDF membrane, and blotted against rabbit polyclonal antibodies against *S. sonnei* form I (FIG. 3A) or Ty21a (FIG. 3B). Sizes of the molecular weight markers in kDa are indicated to the left of the gel. Fixed bacterial cells were co-stained with rabbit anti-*S. sonnei* form I (left panel), and DNA inside the cells was counter-stained with DAPI (right panel) and visualized by fluorescent microscopy. A representative image is shown for Ty21a (FIG. 3C), *S. sonnei* 53G form I (FIG. 3D), Ty21a-Sso (clone #3-1) (FIG. 3E), and Ty21a-Sso (clone #9-26) (FIG. 3F).

FIGS. 4A-4C. Ty21a-ABC expresses enzymatically active GAD in an arabinose-dependent manner. Ty21a (FIG. 4A), *S. sonnei* 53G form II (FIG. 4B), and Ty21a-ABC (FIG. 4C) were grown in TSB supplemented with 1% trehalose (Tre) and/or 0.75% arabinose (Ara) as indicated above at 37° C. with agitation for overnight to saturation. Cells were harvested and assayed for GAD activity as described in materials and methods. A table summarizing results is shown on the right.

FIGS. 5A-5B. Ty21a-YBC expresses enzymatically active GAD and glutaminase (GLNase) in an arabinose inducible manner. Bacterial cells were grown in TSB supplemented with 1% trehalose and indicated amount of arabinose at 37° C. with agitation for overnight to saturation.

Cells were harvested and assayed for GLNase (FIG. 5A) and GAD (FIG. 5B) activity as described in materials and methods. A table summarizing results is shown.

FIG. 6. *S. sonnei* form I O-antigen expressed from Ty21a-YBC-Sso (clone #34-1) exhibits native form I O-antigen morphology. Ty21a-ABC-Sso (clone #20-25) and Ty21a-YBC-Sso (clone #34-1) were grown in TSB supplemented with 1% trehalose or 1% trehalose and 0.75% arabinose at 37° C. with agitation for overnight to saturation. Cells were fixed by 10% formalin, co-stained with rabbit anti-*S. sonnei* form I (green), mouse anti-Ty21a (top panel), and DNA inside the cells was counter-stained with DAPI (bottom panel), and visualized by fluorescent microscopy. Images acquired from the same field were superimposed on each other and a representative image is shown for each of the growth conditions for each strain.

Figure 7A:
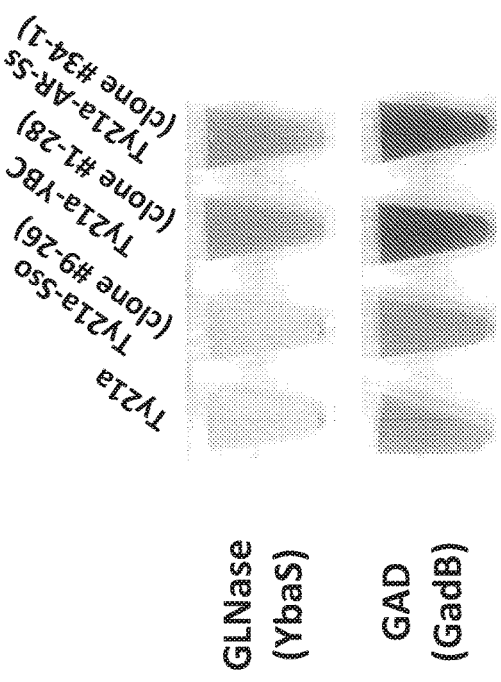
Figure 7B:
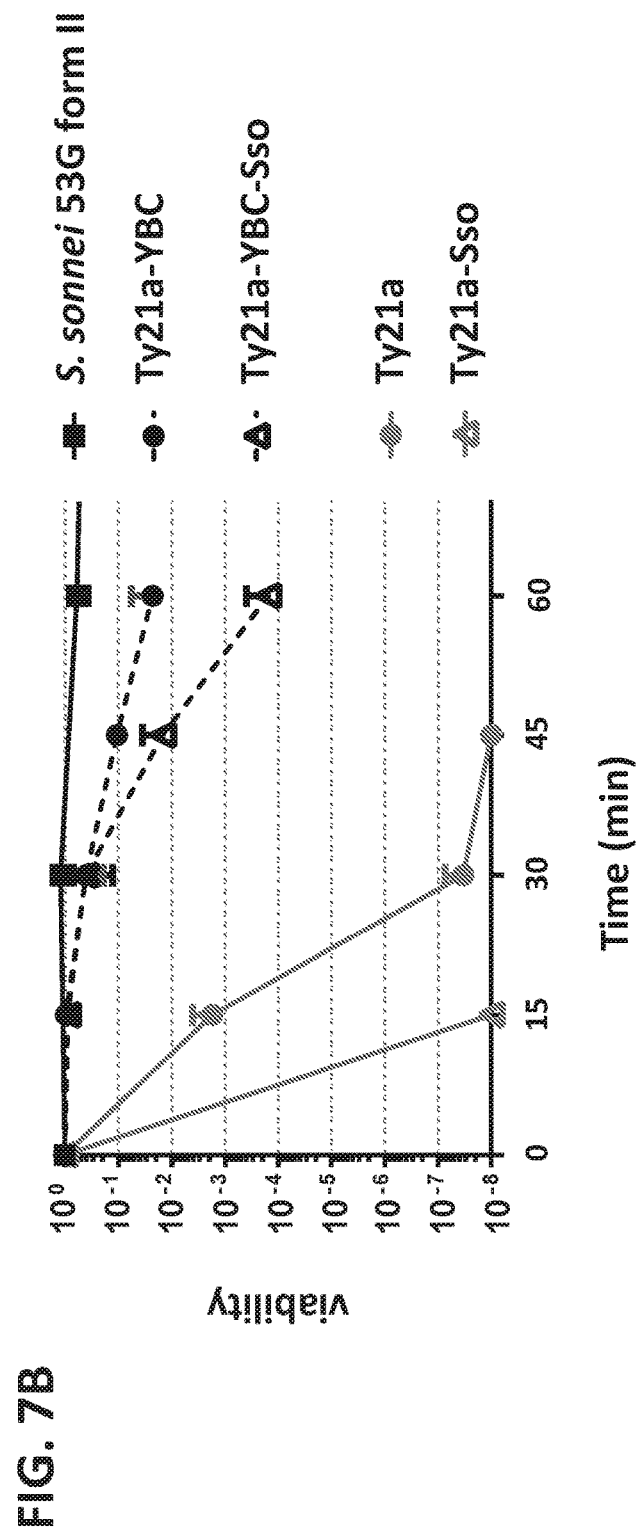

FIGS. 7A-7B. Ty21a-YBC-Sso (clone #34-1) is resistant to acid challenge. Bacterial cells were grown in TSB supplemented with 1% trehalose and 0.75% arabinose at 37° C. with agitation for overnight to saturation. Ty21a and its derivatives from each indicated strains were harvested and assayed for GLNase and GAD activity (FIG. 7A). Cultures were 1:20 diluted into pH 2.5 acid medium containing 1.5 mM glutamine and viable counts were determined for each time point. *S. sonnei* 53G form II: black squares; Ty21a: gray circles; Ty21a-Sso (clone #9-26): gray open triangles; Ty21a-YBC (clone #1-28): black circles; Ty21a-YBC-Sso (clone #34-1): black open triangles (FIG. 7B). Shown here are results obtained from at least three independent experiments (average±SD).

Figure 8:
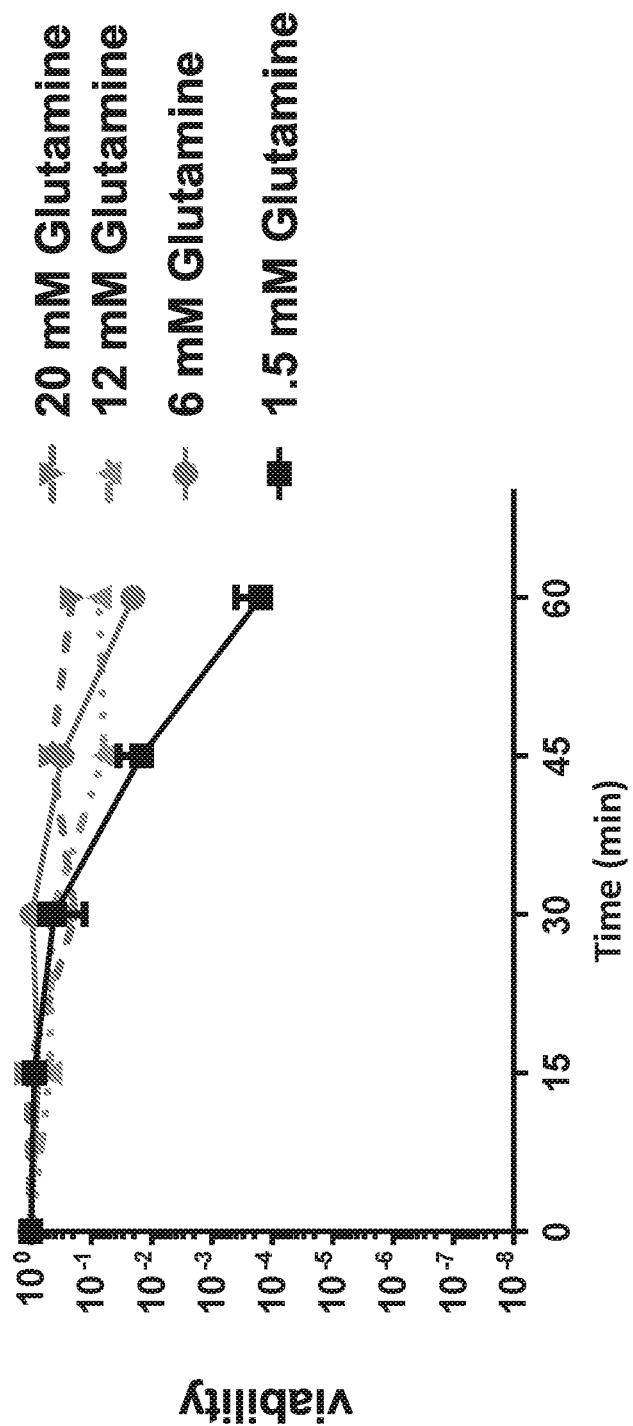

FIG. 8. Increased concentrations of glutamine enhances acid resistance of Ty21a-YBC-Sso (clone #34-1). Ty21a-YBC-Sso (clone #34-1) strain was grown in TSB supplemented with 1% trehalose and 0.75% arabinose at 37° C. with agitation for overnight to saturation. Cultures were 1:20 diluted into pH 2.5 acid medium containing indicated amounts glutamine and viable counts were determined for each time point. Results were obtained from at least duplicate independent experiments (average±SD).

Figure 9A:
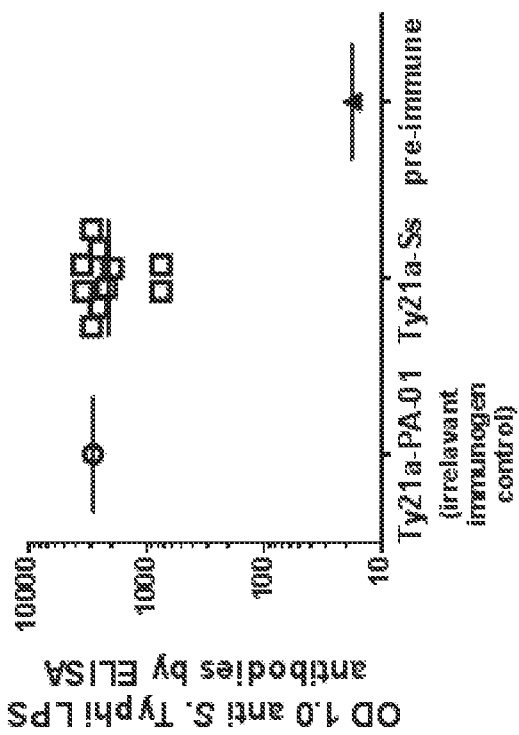
Figure 9B:
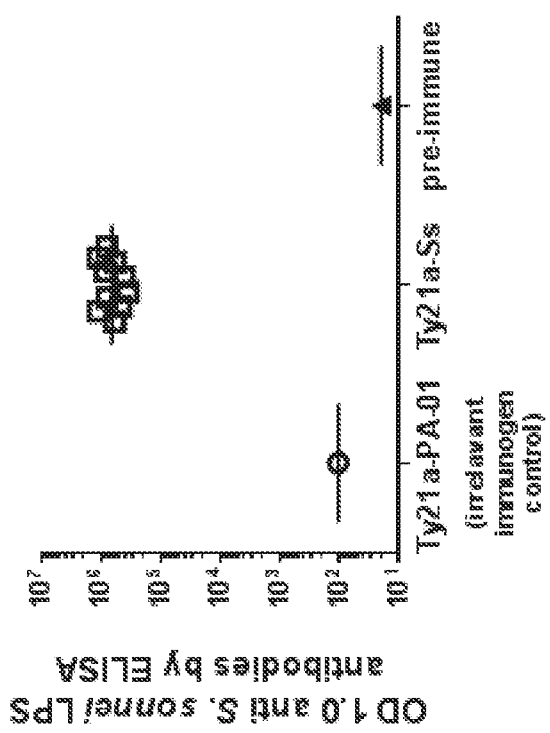

FIGS. 9A-9B. Mice immunized with Ty21a-Sso through the intraperitoneal route produced extremely high levels of serum antibodies against both *S. sonnei* (FIG. 9A) and *S. Typhi* (FIG. 9B).

Figure 10B:
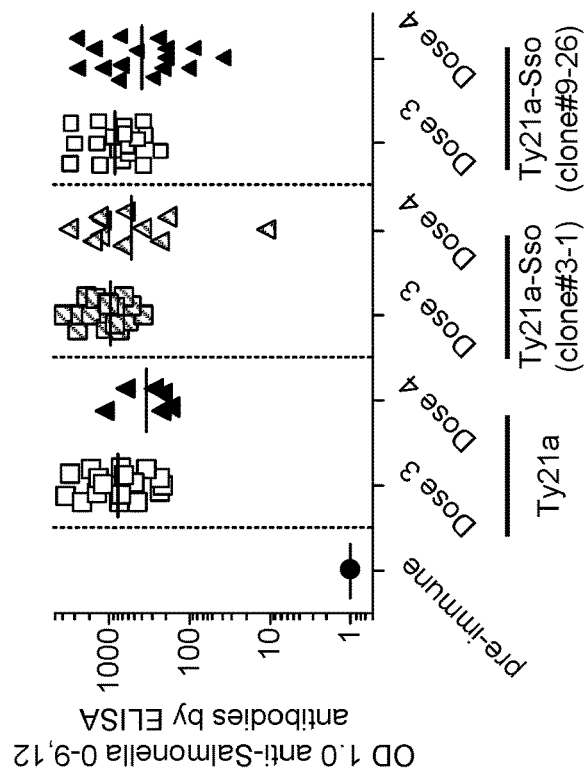
Figure 10A:
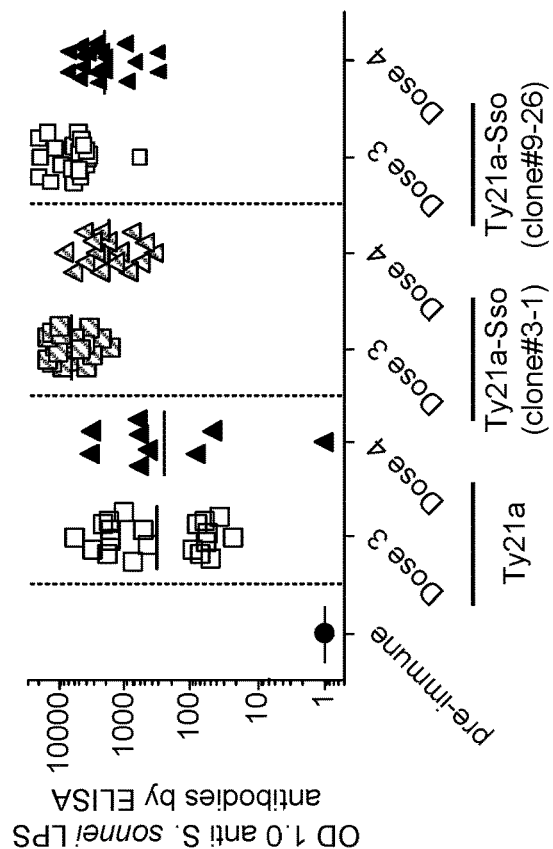

FIGS. 10A-10B. Mice immunized with Ty21a-Sso through the intranasal route produced high levels of serum antibodies against both *Shigella sonnei* (FIG. 10A) and *Salmonella Typhi* (FIG. 10B).

Figure 11:
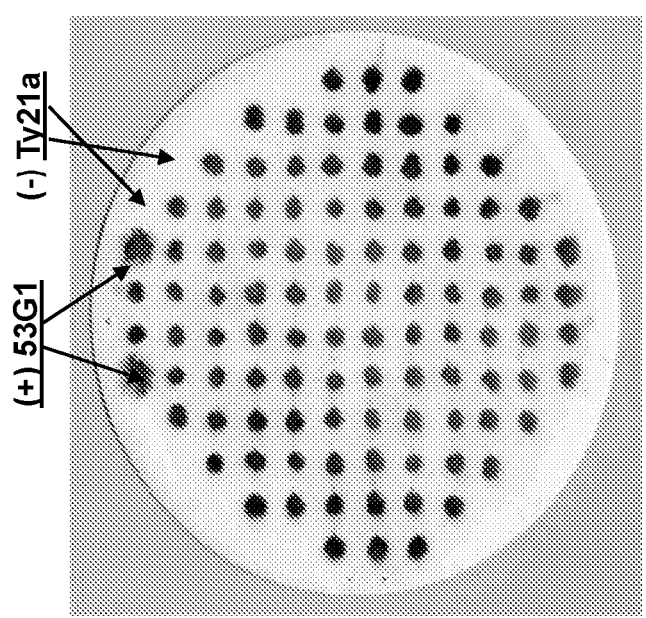

FIG. 11. A representative immunoblot from one of the two random vials from the seed bank for Ty21a-Sso (clone #9-26).

Figure 12:
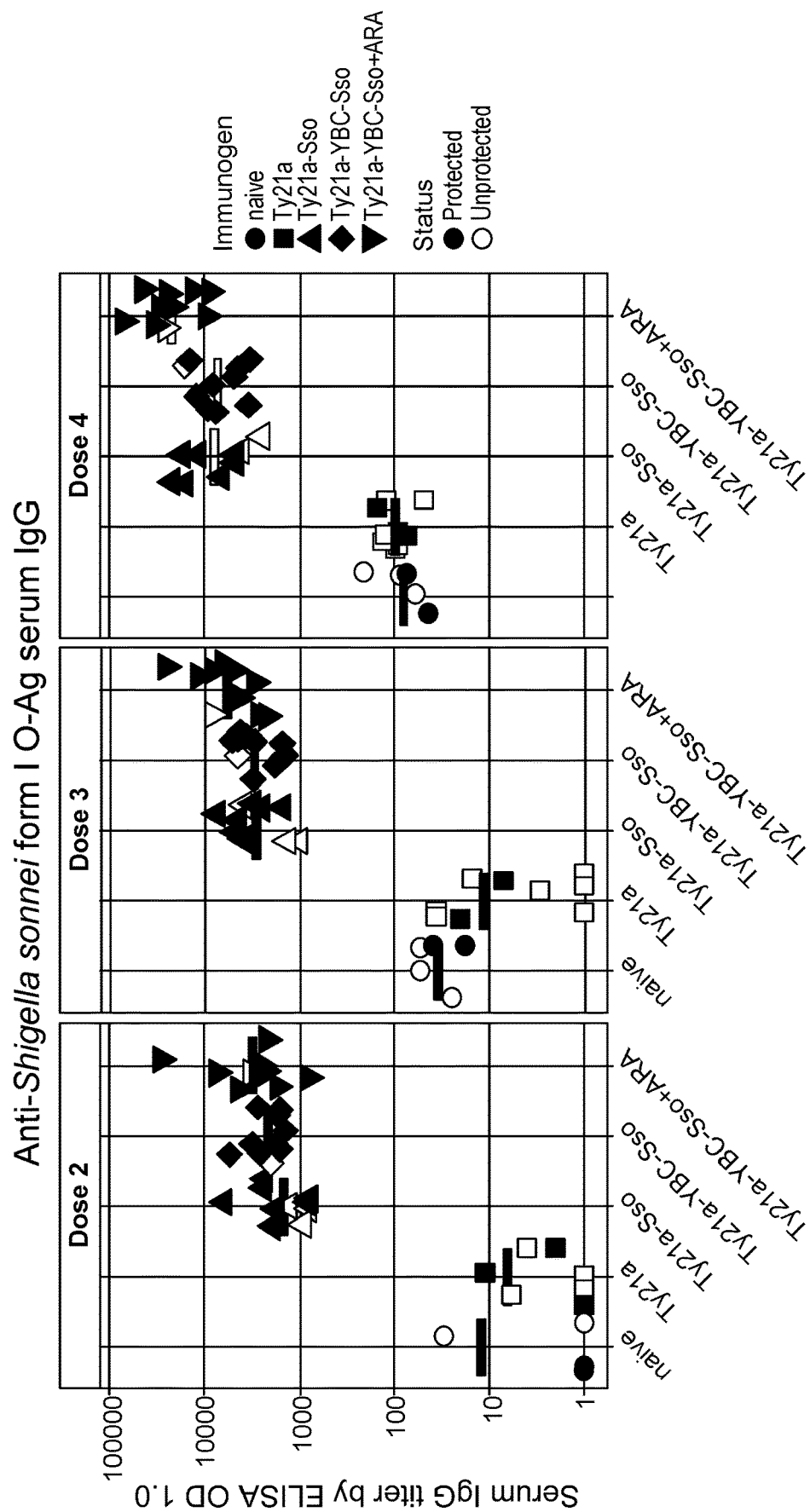

FIG. 12. Serum IgG antibody responses of mice in which Ty21a Sso (clone #9-26) or Ty21a-YBC-Sso (clone #34-1) was administered intranasally was assessed by ELISA.

Figure 13:
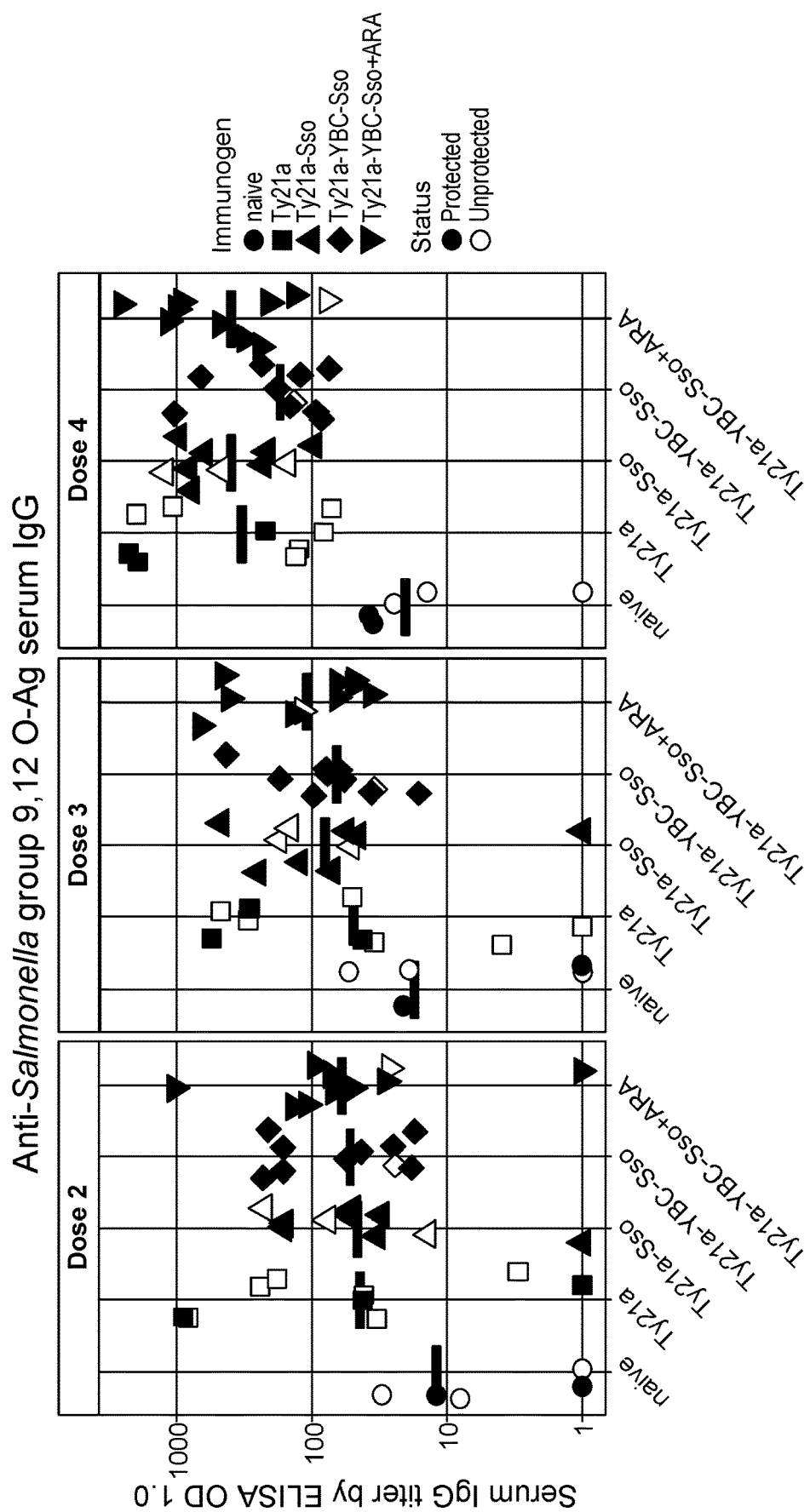

FIG. 13. Serum antibody responses to *Salmonella* groups O 9, 12-antigens, the native O-antigens expressed on Ty21a surface that induced protective immunity against typhoid fever.

Figure 14:
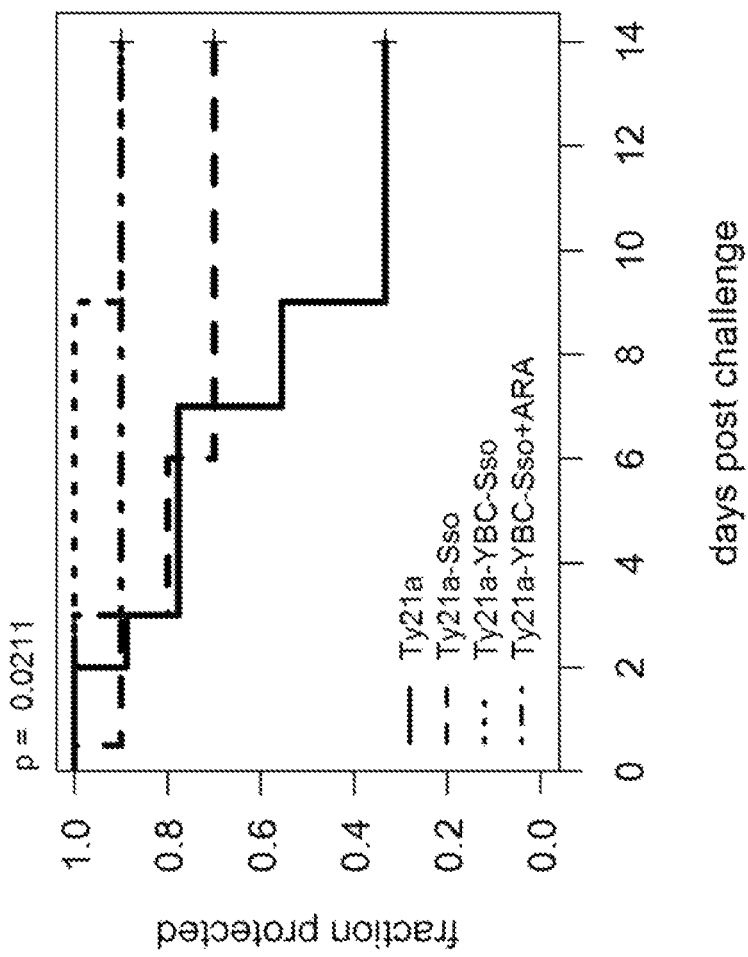

FIG. 14. Shows protection from lethal *S. sonnei* 53G I infection after administration of Ty21a-Sso or Ty21a-YBC-Sso vaccine.

DETAILED DESCRIPTION

Definitions

"Biosynthetic" as used herein means produced by a process whereby one or more substrates are converted to more complex products within a living organism or cell.

"Deoxyribonucleic acid" or "DNA," is a polynucleotide assembled in a particular sequence that encodes a polypeptide. DNA as used herein can include a promoter and/or other transcription or translation control elements operably associated with one or more coding regions. An operable association is when a coding region for a gene product, e.g., a polypeptide, is associated with one or more regulatory sequences in such a way as to place expression of the gene product under the influence or control of the regulatory sequence(s).

"Nucleic acid" refers to any one or more nucleic acid segments, e.g., DNA fragments, present in a polynucleotide. Unless otherwise indicated, a particular nucleic acid sequence also implicitly encompasses conservatively modified variants thereof (e.g., degenerate codon substitutions) and complementary sequences as well as the sequence explicitly indicated. Specifically, degenerate codon substitutions may be achieved by generating sequences in which the third position of one or more selected (or all) codons is substituted with mixed-base and/or deoxyinosine residues (Batzer et al. (1991) Nucleic Acid Res. 19:5081; Ohtsuka et al. (1985) J. Biol. Chem. 260:2605-2608; Cassol et al. (1992); Rossolini et al. (1994) Mol. Cell. Probes 8:91-98).

"Sequence identity" as used herein refers to a relationship between two or more polynucleotide sequences or between two or more polypeptide sequences. When a position in one sequence is occupied by the same nucleic acid base or amino acid residue in the corresponding position of the comparator sequence, the sequences are said to be "identical" at that position. The percentage "sequence identity" is calculated by determining the number of positions at which the identical nucleic acid base or amino acid residue occurs in both sequences to yield the number of "identical" positions. The number of "identical" positions is then divided by the total number of positions in the comparison window and multiplied by 100 to yield the percentage of "sequence identity." Percentage of "sequence identity" is determined by comparing two optimally aligned sequences over a comparison window. In order to optimally align sequences for comparison, the portion of a polynucleotide or polypeptide sequence in the comparison window may comprise additions or deletions termed gaps while the reference sequence is kept constant. An optimal alignment is that alignment which, even with gaps, produces the greatest possible number of "identical" positions between the reference and comparator sequences. The terms "sequence identity" and "identical" are used interchangeably herein. Accordingly, sequences sharing a percentage of "sequence identity" are understood to be that same percentage "identical." In some embodiments, the percentage "sequence identity" between two sequences can be determined using the program "BLAST 2 Sequences" which was available from the National Center for Biotechnology Information, which program incorporates the programs BLASTN (for nucleotide sequence comparison) and BLASTP (for polypeptide sequence comparison), which programs are based on the algorithm of Karlin and Altschul (Proc. Natl. Acad. Sci. USA 90(12):5873-5877, 1993).

A "gene" refers to a locus (or region) of DNA, which is made up of nucleotides that can that can be transcribed into RNA that encode a polypeptide.

"Gene region" as used herein refers to a location within chromosomal DNA that encodes one or more polypeptides of interest (e.g., an antigen).

"Gene system" as used herein refers to one or more genes that encode one or more polypeptides which when expressed in concert produce a desired effect.

"Variant," as used herein, refers to a polypeptide that differs from the recited polypeptide due to amino acid substitutions, deletions, insertions, and/or modifications.

"Functional variant" includes polypeptides that retain at least some of the properties of the corresponding wild-type polypeptide. For example, in some embodiments, the functional variant of an antigen retains at least 90%, at least 91%, at least 92%, at least 93%, at least 94%, at least 95%, at least 96%, at least 97%, at least 98%, at least 99%, or 100% antigenicity and/or protective immunity of the corresponding wild-type antigen.

"Transgenic" as used herein refers to an organism or cell that comprises a gene, a gene region, and/or a gene system that has been transferred to it by genetic engineering techniques.

"Integrated into" as used herein refers to incorporating a heterologous DNA (e.g., a gene, a gene region, and/or a gene system) into a chromosomal DNA.

"Heterologous" as used herein means from a different organism, cell type or species.

"Transformation," "transfection," and "transduction" refer to methods of transferring nucleic acid (i.e., a recombinant DNA) into a cell. The transferred nucleic acid can be introduced into a cell via an expression vector such as a plasmid, usually comprising components essential for selection, expression of target gene(s), and/or replication in the host cell.

"Stably expressed" as used herein refers to expression of a heterologous gene, a gene region and/or a gene system that has been integrated into chromosomal DNA in a fashion that is reproducible through multiple cell passages and/or under a broad range of physiologic conditions.

"Acid stability" as used herein refers to the ability of cells to remain viable at low pH.

An "antigen" (also referred to as an immunogen) as used herein is a molecule capable of inducing an immune response in a host organism (e.g., a human) that is specific to that molecule.

"Immune response" as used herein means a response in a host organism, e.g., a human, to the introduction of an immunogen (e.g., a transgenic Ty21a of the application) generally characterized by, but not limited to, production of antibodies and/or T cells. In some embodiments, an immune response may be a cellular response such as induction or activation of CD4+ T cells or CD8+ T cells specific for an antigen, a humoral response of increased production of pathogen-specific antibodies, or both cellular and humoral responses.

"Vaccine" as used herein is a composition comprising an immunogenic agent (e.g., an immunogen or antigen) and a pharmaceutically acceptable diluent or carrier, optionally in combination with excipient, adjuvant and/or additive or protectant.

In certain embodiments, when a vaccine is administered to a subject, the immunogen (e.g., a transgenic Ty21a of the application) stimulates an immune response that will, upon subsequent exposure to an infectious agent, protect the subject from illness or mitigate the pathology, symptoms or clinical manifestations caused by that agent. In some embodiments, a therapeutic (treatment) vaccine is given after infection and is intended to reduce or arrest disease progression. In some embodiments, preventive (prophylactic) vaccine is intended to prevent initial infection or reduce the rate or burden of the infection.

"Carrier" as used herein refers to a substance that renders a composition suitable for pharmaceutical use. In some embodiments, the carrier is selected from the group consisting of water, PBS, saline, or any combination thereof. In another embodiment the carrier is selected from the group consisting of sucrose, ascorbic acid, amino acid mixture, lactose, magnesium stearate, or any combination thereof, "Conferring protective immunity" refers to providing to a subject (i.e., an individual) or a human population (e.g., at least 10 subjects) the ability to generate an immune response to protect against a disease (e.g., shigellosis or typhoid fever) caused by subsequent exposure to a pathogen (e.g., a bacteria) such that the clinical manifestations, pathology, or symptoms of disease are reduced during subsequent exposure to the pathogen as compared to a non-treated subject, or such that the rate at which infection, or clinical manifestations, pathology, or symptoms of disease appear within a population are reduced, as compared to a non-treated population.

"Human population" as used herein refers to a group of humans which can be represented by a defined number of subjects, e.g., at least 10 subjects.

"Dose" as used herein refers to a distinct administration event to a subject.

"Immunized" as used herein means sufficiently vaccinated to achieve a protective immune response.

In certain embodiments, as used herein, the term "about" means plus or minus 5% of the numerical value of the number with which it is being used. Therefore, about 85% means in the range of 80% to 90% as described herein.

Compositions

This invention discloses the preparation and use of Ty21a vectors to express foreign immunogens, e.g., *Shigella sonnei* or *E. coli* genes. In some embodiments, the attenuated *Salmonella enterica* serovar *typhi* vaccine Ty21a as an expression vector for *Shigella sonnei* genes, e.g., stably integrated into the Ty21a chromosome. In some embodiments, the attenuated *Salmonella enterica* serovar *typhi* vaccine Ty21a as an expression vector for Enterotoxogenic *E. coli* (ETEC) antigens, e.g., stably integrated into the Ty21a chromosome.

In addition to providing bivalent protection against both typhoid fever and shigellosis, integration of an acid resistance cassette provides acid stability and enhances viability of recombinant Ty21a as it passes through the stomach where conditions are acidic, thereby providing for more stable gene expression. This can also eliminate the need for gelatin capsules or liquid formulations and provides temperature stabilization and extended shelf life.

In some embodiments, of Ty21a vector used to express foreign immunogens is a transgenic *Salmonella typhi* Ty21a comprising a heterologous *Shigella sonnei* O-antigen biosynthetic gene region and a heterologous acid resistance biosynthetic gene system, said biosynthetic O-antigen gene region and said acid resistance biosynthetic gene system both being integrated into the *Salmonella typhi* Ty21a chromosome.

In an embodiment, the heterologous *Shigella sonnei* O-antigen biosynthetic gene region of the transgenic Ty21a comprises a wzz gene. In some embodiments, the wzz gene comprises a DNA sequence that shares at least 90%, at least 95%, or 100% sequence identity with the DNA sequence of nucleic acids 4,511,904 to 4,513,010 of SEQ ID NO: 4 or a complementary sequence thereof, the DNA sequence of nucleic acids 4,511,904 to 4,513,010 of SEQ ID NO: 4 or a complementary sequence thereof; or a DNA sequence that encodes a functional variant of the polypeptide encoded by the DNA sequence of nucleic acids 4,511,904 to 4,513,010 of SEQ ID NO: 4 or a complementary sequence thereof.

In an embodiment, the heterologous *Shigella sonnei* O-antigen biosynthetic gene region of the transgenic Ty21a comprises a DNA sequence that shares at least 90% o, at least 91%, at least 92%, at least 93%, at least 94%, at least 95%, at least 96%, at least 97%, at least 98%, at least 99%, or 100% sequence identity with the DNA sequence of nucleic acids 4,500,076 to 4,513,461 of SEQ ID NO: 4 or a complementary sequence thereof; the DNA sequence of nucleic acids 4,500,076 to 4,513,461 of SEQ ID NO: 4 or a complementary sequence thereof; or a DNA sequence that encodes a functional variant of the polypeptide encoded by the DNA sequence of nucleic acids 4,500,076 to 4,513,461 of SEQ ID NO: 4 or a complementary sequence thereof.

In an embodiment, the transgenic Ty21a heterologous acid resistance biosynthetic gene system comprises a YbaS gene. In some embodiments, the YbaS gene comprises a DNA sequence that shares at least 90%, at least 91%, at least 92%, at least 93%, at least 94%, at least 95%, at least 96%, at least 97%, at least 98%, at least 99%, or 100% sequence identity with the DNA sequence of nucleic acids 4,503,240 to 4,504,172 of SEQ ID NO: 1 or a complementary sequence thereof; the DNA sequence of nucleic acids 4,503,240 to 4,504,172 of SEQ ID NO: 1 or a complementary sequence thereof; or a DNA sequence that encodes a functional variant of the polypeptide encoded by the DNA sequence of nucleic acids 4,503,240 to 4,504,172 of SEQ ID NO: 1 or a complementary sequence thereof.

In an embodiment, the transgenic Ty21a comprises a nucleic acid insert comprising AraC-YbaS-GadBC-Sso O Ag wzz+. In some embodiments, the AraC-YbaS-GadBC-Sso O Ag wzz+ insert comprises a DNA sequence that shares at least 90%, at least 91%, at least 92%, at least 93%, at least 94%, at least 95%, at least 96%, at least 97%, at least 98%, at least 99%, or 100% sequence identity with the DNA sequence of nucleic acids 4,500,075-4,518,404 of SEQ ID NO:6 or a complementary sequence thereof; the DNA sequence of nucleic acids 4,500,075-4,518,404 of SEQ ID NO:6 or a complementary sequence thereof; or a DNA sequence that encodes a functional variant of the polypeptide encoded by the DNA sequence of nucleic acids 4,500,075-4,518,404 of SEQ ID NO:6 or a complementary sequence thereof.

In some embodiments, the transgenic *Salmonella typhi* Ty21a vector comprises a nucleic acid sequence that shares at least 90%, at least 91%, at least 92%, at least 93%, at least 94%, at least 95%, at least 96%, at least 97%0, at least 98%, at least 99%, or 100%/sequence identity with the sequence of SEQ ID NO: 1, SEQ ID NO:2, SEQ ID NO:3, SEQ ID NO:4, SEQ ID NO:5, SEQ ID NO:6, or a complementary sequence thereof.

The use of Ty21a as a vector platform to express foreign immunogens derived from other infectious agents as transgenes addresses several significant challenges in the field of vaccine development: 1) The lack of a licensed vaccine for prevention of morbidity and mortality due to shigellosis; 2) The need for a multivalent vaccine that will simultaneously protect against multiple disease agents (e.g., typhoid fever and *S. sonnei* shigellosis), and 3) The need for an easy-to-administer, child-friendly, safe, oral vaccine vector platform for stable expression and administration of multiple foreign antigens, that generates long term efficacy following a rapid immunization regimen and can be distributed without the need for refrigeration. These challenges are addressed by the bivalent typhoid/shigellosis vaccine disclosed herein.

In an embodiment, the transgenic *Salmonella typhi* Ty21a of the invention comprises a heterologous Enterotoxogenic *E. coli* (ETEC) antigen biosynthetic gene region and, optionally, a heterologous acid resistance biosynthetic gene system, said ETEC biosynthetic gene region and said optional acid resistance biosynthetic gene system both being integrated into the *Salmonella typhi* Ty21a chromosome, wherein:

a. heterologous ETEC antigen is stably expressed;

b. one or more heterologous acid resistance enzymes are stably expressed;

c. said transgenic *Salmonella typhi* Ty21a is more stable at pH 2.5 than *Salmonella typhi* Ty21a without the inserted acid resistance biosynthetic gene system;

d. an immune response is elicited against virulent Enterotoxogenic *E. coli* challenge; and/or e. an immune response is elicited against virulent *Salmonella typhi* challenge.

Methods of Use

As used herein, a "human population" is a designated group of human individuals, e.g., at least two individuals. For example, a human population comprises those individuals participating in a clinical trial, or individuals that have received a vaccine and are then challenged to assess protection.

In certain embodiments, administration of a vaccine or composition of the invention to a human population reduces the incidence of shigellosis, typhoid fever, or both in that human population subsequently exposed to pathogenic *Shigella sonnei* and/or *S. typhi*.

In certain embodiments, a method of treating, preventing, or reducing the incidence of shigellosis and/or typhoid fever in a human subject is disclosed, e.g., comprising oral administration of one or more doses of a vaccine or composition of the invention.

In some embodiments, the administration route is oral or nasal. In some embodiments, the administration (e.g., immunization) and/or infection route is oral (per os). In another embodiment, the administration (e.g., immunization) route is nasal. The major barrier for a live oral vaccine is the extreme low pH the vaccine encounters in the stomach. *Salmonella* does not survive well under conditions <pH 3, while most *E. coli* strains and *Shigella* spp. can maintain viability in stomach for several hours [21, 22]. The ability of *Shigella*, and the inability of *Salmonella*, to survive at low pH may partially explain why only 10-100 *Shigella* cells are sufficient to cause infection, while the infective dose for *Salmonella* spp. ranges at ~10' CFU. *Salmonella* expresses acid tolerance response (ATR) genes in response to moderately low pH, which protect the cells from acid challenge as low as pH 3 [21, 23-26]. Ty21a inherited an rpoS mutation from its parental strain Ty2 [27], and carries other less well defined mutations from the random mutagenesis process during strain attenuation [28]. Perhaps because of these mutations, Ty21a develops a poor ATR response and is particularly sensitive to low pH [29]. However, Ty21a viability is important for vaccine efficacy, as a previous report demonstrated that, when administered orally, live Ty21a elicited stronger and longer lasting immune responses in humans than killed Ty21a [30]. To facilitate the journey from mouth to ileum without being eliminated in the gastric acid environment, Ty21a is presently placed in enteric-coated capsules that withstand gastric low pH. Additionally, when administered as a liquid with a buffer, Ty21a was more protective [12]. On the other hand, capsules are child-unfriendly and adversely impact compliance. Also, the Ty21a liquid formulation has been commercially unsuccessful, in part because it is cumbersome.

To obviate the need for special capsules or liquid formulation in buffer, increase bioavailability, reduce dosage requirements, and increase immunogenicity, Ty21a has been rendered acid stable. There are 5 bacterial acid resistance (AR) pathways, which utilize excess protons to decarboxylate a specific amino acid (e.g. aspartic acid, phenylalanine, lysine, or glutamic acid), and an antiporter that transports the decarboxylated product extracellularly [31, 32]. The ability of E. coli, Shigella, Listeria monocylogenes and Lactococcus lactis to withstand extreme acidic pH (below pH 2.5) primarily relies on the most potent AR system, AR2, also known as the glutamate-dependent acid resistance (GDAR) pathway [21, 33]. AR2 consists of the enzyme glutamate decarboxylase (GAD), encoded by the homologous genes gadA and gadB, and a membrane bound antiporter, encoded by the gene gadC. The two GAD isoforms, GadA and GadB, consume an intracellular proton to decarboxylate glutamate, producing γ-amino butyric acid (GABA) and $CO_2$ [23, 34-37] while GadC pumps the substrate (glutamate) and product (GABA) in and out of the cell (FIG. 1A and reviewed in [35]). Genes of the two GAD isoforms are located in two distinct chromosomal loci, with gadB and gadC transcribed as a dicistronic operon, and gadA from a separate gene locus [35, 38, 39]. GadA and GadB are highly similar, with sequence identity of 96.5% at nucleotide level and 98.7% at protein level. Deletion of either gadA orgadB does not affect the cell's AR ability, suggesting these two isozymes are functionally redundant. Recently, a newly discovered glutamine-dependent AR system in E. coli [40] and Lactobacillus reuteri [43] was reported. In E. coli, a previously uncharacterized bacterial glutaminase A, encoded by the gene ybaS, converts glutamine into glutamate in acidic conditions and releases an ammonium, neutralizing an intracellular proton [40]. Interestingly, the antiporter responsible for substrate-product transportation across cell membrane is also GadC [40], consistent with the broad substrate specificity of GadC in vitro [41]. Because the product of glutaminase is precisely the substrate of GAD, the YbaS-GadC and GAD-GadC systems work in concert to convert a glutamine molecule into GABA, neutralizing two protons in the cell (FIG. 1B and [40]), thereby doubling the proton-reducing capacity of the system. This concerted AR system functions more efficiently than the GAD-GadC system alone.

In addition to providing bivalent protection against both typhoid fever and shigellosis, in some embodiments, integration of an acid resistance cassette eliminates the need for gelatin capsules or liquid formulations and provides temperature stabilization and extended shelf life.

Materials and Methods

Bacterial Strains and Growth Conditions.

Bacterial strains used or generated in the Examples are listed in Table I. Ty21a was commercially purchased as enteric-coated capsules from Vivotif Berna Vaccine pharmaceutical (Crucell, Fla., USA). A seed bank was made in the CY medium (1.2% yeast extract, 2% Hy-Case, 1.2% pepticase, 0.125% $NaH_2PO_4$, 0.33% NaCl, pH 7.2, with 0.2% glucose and 0.005% galactose), which is also adopted by Vivotif for production [10]. Shigella sonnei 53G was a gift from Dr. Dennis J. Kopecko [42]. Form I S. sonnei 53G was selected from form II S. sonnei based on a smooth colony morphology on a tryptic soy agar (TSA) plate at least once before use. Competent E. coli NEB5α cells for cloning were purchased from New England Biolabs (NEB, Ipswich, Mass.). Ty21a and derivatives were grown in TSA or tryptic soy broth (TSB) supplemented with 0.02% galactose. S. sonnei strains were grown in TSA or TSB. E. coli strains were grown in Luria-Bertaini (LB) broth or agar.

Plasmids.

Plasmids used or generated in the Examples are listed in Table I. Standard molecular biology techniques are used for cloning. Enzymes for cloning and Phusion high-fidelity PCR master mix were purchased from NEB. The integrity of all plasmid generated in this study was confirmed by DNA sequencing analysis.

(i) Construction of pMDTV::Sso O Ag (wzz−). Sequences of the S. sonnei form I O antigen gene cluster were PCR amplified from genomic DNA of form I S. sonnei 53G. Primers SalI-wzz-496F (5'-tacagtcGAC ATAGATTTCC AGAGAAAATC AG-3') and BamHI-wzy-D99R (5'-attggatcCA TTGCTCAGTC CGGTTGGT-3') were used to amplify part of wzz gene through wzy. Primers BamHI-wbgV-U14F (5'-attggatccA AGCGCAGCTA TTTAGGATG-3') and XhoI-apZ-D5R (5'-acatctcgaG CTGGTTAATT TACGGGGTG-3') were used to amplify full-length wbgV through aqpZ. The two PCR products were first cloned into pUC19-based vector for DNA amplification and sequence verification and then subcloned sequentially into pMDTV vector within SalI-XhoI sites as illustrated in the schematic diagram in (as pWR101 wzz− of FIGS. 2A, 2B).

(ii) Construction of pMDTV::Sso O Ag wzz+. Cloning procedures were the same as that of pMDTV::Sso O Ag (wzz−) except primer SalI-wzz-m1-U100F (5'-TACAgtc-gac GCGCTTTGGG AGCTGAAACT-3') was used instead of SalI-wzz-496F so that the PCR fragment included the full-length wzz gene as well a 100-bp upstream sequence containing a putative promoter and ribosome binding site (as pSs046 wzz+ of FIGS. 2A, 2B).

(iii) Construction of pUC19::TviD-AraC-GAD-KanR-VexA. Sequences of tviD, a flippase-recognition target (FRT) site-flanked kanamycin resistant cassette (KanR), and vexA were from pMDTV [19]. Sequence of AraC and the arabinose-inducible promoter ($P_{ara}$) was from pKD46. Sequences of GadA, GadB and GadC (GAD) were PCR amplified from pGAD containing Shigella flexneri 2a gadA, gadB and gadC gene sequences as a consecutive polycistronic operon. DNA sequences were either subcloned or PCR-cloned into a pUC19 based vector in the order (5' to 3') as described in the plasmid name and the expression of GadA, GadB, and GadC is driven by $P_{ara}$.

(iv) pUC19::TviD-AraC-YbaS-GadBC-KanR-VexA. Sequence of ybaS gene was PCR amplified from S. sonnei 53G genomic DNA and cloned into pUC19::TviD-AraC-GAD-KanR-VexA to replace GadA. Expression of YbaS, GadB, and GadC is driven under $P_{ara}$.

(v) Construction of pTIKV::AraC-YbaS-GadBC-Sso OAg. The NheI-SacII fragment of pMDTV::Lpp-F1V-HlyAs, containing the pGB2 backbone, was used to replace the pUC19 backbone of pUC19::TviD-AraC-YbaS-GadBC-KanR-VexA, resulting pTIKV::AraC-YbaS-GadBC. The XhoI-SpeI fragment of pTIKV::AraC-YbaS-GadBC, containing the KanR-VexA sequence, was subcloned into the XhoI-SpeI fragment of pMDTV::Sso O Ag wzz+ to replace the VexA sequence. The NheI-XhoI fragment of pTIKV::AraC-YbaS-GadBC, containing the TviD, AraC, YbaS, and GadBC sequences, were then subcloned into the NheI-SalI sites of the cloning intermediate, resulting a final product pTIKV::AraC-YbaS-GadBC-Sso O Ag wzz+.

Construction of Ty21a Derivatives.

Strains generated in the Examples are listed in Table I. Unless otherwise specified, PCR fragment was amplified from the constructed plasmid described above by the Phusion high-fidelity PCR using Primers TviD-2004F (5'-TGATTGCTAA CGTCATGAGC-3') and VexA-1066R (5'-

AGAAAGAATT AGTGCCGCGG-3') and genome integration was as described by the λ Red recombination-based recombineering technology) [19, 43]. The KanR selectable marker was deleted from the chromosomal integrants by transforming cells with pCP20 and selecting for Kans transformants as described [19, 44]. Chromosomal integration and selection marker eviction were confirmed by genomic PCR analysis and antibiotics sensitivity tests.

(i) Ty21a-Sso and Ty21a-Sso wzz+. SpeI-linearized plasmids pMDTV::Sso O Ag (wzz−) and pMDTV::Sso O Ag wzz+ were used as PCR templates, resulting in a PCR product that contains the 3' ~500 bp of tviD gene, KanR, the Sso form I O Ag gene cluster without or with wzz expression, and ~1000 bp of the vexA gene. The tviD and vexA sequences provide homology for site-specific DNA recombination. The PCR fragment was integrated into the Ty21a chromosome as described above. Expression of *S. sonnei* form I O antigen and *Salmonella Typhi* O9, 12 antigens were confirmed by Western blot analysis of extracted lipopolysaccharide (LPS, described below) or immunofluorescence assay (described below).

(ii) Ty21a-ABC and Ty21a-YBC. The NheI-SacII fragment of pUC19::TviD-AraC-GAD-KanR-VexA or pUC19::TviD-AraC-YbaS-GadBC-KanR-VexA was liberated by restriction enzymes, gel purified, and used to transform Ty21a for chromosome integration as described above, resulting Ty21a-ABC (short for Gad<u>A</u>, Gad<u>B</u>, and Gad<u>C</u>) and Ty21a-YBC (for Yba<u>S</u>, Gad<u>B</u>, Gad<u>C</u>). Expression of YbaS, GadA/GadB, and GadC upon arabinose induction was confirmed by biochemical activity assays (described below in GAD and glutaminase assays) and cell viability upon acid challenge was assessed by acid resistance assay (described below).

(iii) Ty21a-ABC-Sso and Ty21a-YBC-Sso. SpeI-linearized pTIKV::AraC-YbaS-GadBC-Sso OAg was used as template DNA for PCR amplification. Due to the low PCR amplification yield, PCR primers GadC-IF (5'-ATGGCTACAT CAGTACAGAC-3') and VexA-1066R were used, producing a PCR product comprising GadC, Sso O Ag cluster with full-length wzz, KanR, and VexA. The PCR fragment was integrated into the chromosome of Ty21a-ABC or Ty21a-YBC as described above. Expression of *S. sonnei* form I O antigen and *Salmonella Typhi* O9, 12 antigens were confirmed by Western blot analysis of extracted LPS or immunofluorescence assay. Expression of YbaS, GadA/GadB, and GadC upon arabinose induction was confirmed by biochemical activity assays and cell viability upon acid challenge was assessed by acid resistance assay.

Western Blot Analyses.

O antigens were extracted using an LPS Extraction Kit (iNtRON Bio, Gyeonggi-do, South Korea) followed by proteinase K (NEB) treatment in 10 mM Tris-HCl, pH 8.0 at 37° C. for Overnight. Immediately before loading onto gel, purified LPS was digested by proteinase K in 0.5% SDS at 56° C. for 1 hr. Samples were then heated at 95° C. for 5 min and resolved on a 4-20% Tris-glycine SDS-PAGE gel. Resolved samples from the gel were transferred to a PVDF membrane and blotted with either a rabbit anti-*S. sonnei* serum (Abcam) pre-absorbed with Ty21a and form II *S. sonnei* 53G or a rabbit anti-Ty21a serum (Sim B K L et al., 2015, in submission).

Immunofluorescence Assay.

Cells were fixed by directly adding formalin (37% formaldehyde) to a bacterial culture to a final concentration of 10% and incubated at ambient temperature for 20 minutes on a rotary shaker. The fixed cells were washed three times with PBS before spotted on a glass slide and air-dried overnight. The slide was blocked with 1% bovine serum albumin (BSA) in phosphate-buffered saline (PBS) at ambient temperature for 30 min before reacting with first antibodies of pre-absorbed rabbit anti-*S. sonnei* form I serum and mouse anti-Ty21a serum diluted in 1% BSA in PBS at 37° C. for 30 min [Sim B K L et al., 2015, submitted for publication]. Alexa Fluor 488-conjugated goat anti-rabbit IgG and Alexa Fluor 564-conjugated goat anti-mouse IgG (Life Technologies) were used as secondary antibodies and mounting fluid containing DAPI (Vector Laboratories, Burlingame, Calif.) were used for DNA counter-staining. Samples were visualized and images captured on an Olympus DP70 digital microscope camera system and images were processed by DP manager.

Glutaminase and GAD Activity Assays.

Glutaminase and GAD assays were modified from a previously published GAD assay [45]. The glutaminase reagent consisted of 0.1% L-glutamine (Sigma), 9% NaCl, and 0.1 mg/mL bromocresol green (Sigma), pH 3.6 and the GAD reagent consisted of 0.1% L-glutamic acid (Sigma), 90/% NaCl, and 5 mg/mL bromocresol green (pH 3.4). 1 OD of cells (defined as the equivalent of 1 mL of culture with an absorbance at 600 nm of 1.0, corresponding to ~$10^9$ viable cells) were pelleted and resuspended in 0.5 mL of glutaminase or GAD reagent. Tubes were incubated at 37° C. for 1 hr. A change of color from yellow to greenish-blue or blue was considered a positive and a yellow color was scored as negative.

Acid Resistance Assay.

Acid buffer (50 mM citric acid, 50 mM phosphoric acid, 0.9% NaCl, pH 2.5) was prepared and sterilized by filtering through 0.2 μm. Glutamine was freshly prepared on the day of experiment by dissolving glutamine powder in 1 N HCl to a final concentration of 0.3 M. NaOH was added according to the amount of glutamine added to neutralize the acidity from HCl. Unless otherwise indicated, cells were grown in TSB+0.02% galactose+1% trehalose (Tre)+0.75% arabinose (Ara) at 37° C. for overnight with agitation at 220 rpm. The next day, the saturating culture was diluted 1:20 into acid medium (acid buffer supplemented with 0.75% arabinose and glutamine at indicated concentration) and incubated at 37° C. with agitation. At indicated time points, an aliquot of culture was taken out, diluted in DPBS (Hyclone), and cultures with proper dilution were either spotted 5 μL/spot (for a spot assay) or spread 100 μL/plate (for a plate enumeration) on TSA plate. Plates were incubated at 37° C. for 1 day and bacterial growth was quantified. Cell viability at a given time point is expressed as the fraction of mean viable counts with respect to that at 0 time point.

Results

Construction of a recombinant Ty21a strain with a stable chromosomal integrant of *S. sonnei* form I O-antigen gene cluster has be disclosed by inventors including a co-inventor herein [19]. It was found however, that Ty21a strain was constructed from a lab strain that had been propagated over decades and the donor DNA for *S. sonnei* form I O-antigen genes was a plasmid derived from multiple subclonings [46] and has an IS element interruption at the wzz gene compared with the sequences from another independently published report, pSs046 [47]. Therefore, we re-constructed the vaccine strain from a cell bank made from commercially purchased Ty21a Vivotif® pharmaceutical capsules (Crucell) and *S. sonnei* 53G form I [42] to ensure that the vaccine strains disclosed herein have trackable pedigrees.

The transgenic constructs disclosed herein have at least the following improvements as compared to the Ty21a-Sso combinatorial vaccine candidate in Int. Publ. number WO2014043637 A1): (1) inclusion of the full-length *S. sonnei* wzz gene that encodes the O-antigen length control protein together with the rest of the gene cluster, which renders *S. sonnei* form I O-antigen expressed on Ty21a surface exhibiting better morphologically resemblance to the native form on *S. sonnei*; (2) co-expression from Ty21a chromosome with the *S. sonnei* form I gene cluster a concerted glutamine/glutamate-dependent acid resistance genes, including acid-activated glutaminase YbaS, glutamate decarboxylase GadB, and glutamate-GABA antiporter GadC, which enhance acid resistance of the said vaccine strain and presumably facilitate gastric transit of the bacterial vaccine and induce more potent and long-lasting immune responses in vaccines.

Immunogenicity of Recombinant Ty21a-Ss vaccine strains in mice was assessed. Example 9 provides the results from ELISA assays of the sera of mice in which Ty21a-Sso (clone #9-26) and Ty21a-YBC-Sso (clone #34-1) was administered intranasally. Example 10 provides the results of serum antibody response of immunized mice to *Salmonella* groups O 9, 12-antigens, the native O-antigens expressed on Ty21a surface that induced protective immunity against typhoid fever. Examples 9 and 10, taken together, demonstrate that the *S. sonnei* form I O-antigen expressed on the cell surface of the recombinant vaccine strains was immunogenic when administered through mucosal routes. Meanwhile, recombinant Ty2 I a-Sso strains retained the immunogenicity of Ty21a and stimulated anti-*Salmonella* groups 9, 12 O-antigens at a level similar to the Ty21a vector. Moreover, co-expression of the AR genes did not affect the immunogenicity of the *S. sonnei* form I or the *Salmonella* groups 9, 12 O-antigens. Activation of AR genes slightly enhanced the antibody titers to both *S. sonnei* form I and *Salmonella* groups 9, 12 O-antigens, although the differences are not statistically significant.

EXAMPLES

Example 1

Stable Integration and Expression of *S. sonnei* (Sso) Form I O-Antigen from Ty21a Chromosome, Free of Antibiotic Resistance Gene The sequence of form I O-antigen gene cluster from the genomic DNA of *S. sonnei* 53G form I was amplified and inserted it into the silent Vi gene region of Ty21a chromosome between the tviD and vexA sequences using genetic recombineering technology [19] (FIGS. 2A-2C). The insert spanned from the wzz ORF through the end of the aqp gene, with the exception of the insertional element IS630 between the wzy and wbgV genes. Because of the divergence of wzz in two published reports [46, 47], both an wzz– strain resembling the previous Ty21a-Ss construct [19], in which the gene cluster encompasses from the 3'-612 bp of wzz through the end of aqp genes, and a wzz+ strain, in which full-length wzz sequence and a 100-bp upstream sequence were included in the insert, were constructed. The 100-bp upstream sequence covers the conserved 5' border of O-antigen clusters [47] and a Shine-Dalgarno consensus sequence immediately upstream to wzz drives wzz expression.

After chromosome integration was confirmed, the selectable antibiotics marker was deleted from the insert, leading to final, marker-less chromosomal integrants, designated as Ty21a-Sso (clone #3-1) and Ty21a-Sso wzz+ (clone #9-26). There were 6 nucleotide polymorphisms identified within this cloned *S. sonnei* form I gene cluster sequence in comparison to the previous published sequence (pWR101) [46]. Five of the polymorphisms were non-synonymous mutations and one was located within intergenic region. By DNA sequencing of independently amplified PCR fragments it was confirmed that these polymorphisms were present in *S. sonnei* 53G form I genome. Moreover, three of the polymorphisms are present in the sequence of pSs046 [47]. Therefore, these polymorphisms arose from variation between lab isolates.

Example 2

*S. sonnei* Wzz Gene Promote Uniform Distribution of *S. sonnei* Form I O-Antigen on Ty21a Cell Surface, Resembling the Native *S. sonnei* Form I O-Antigen Expression of the *S. sonnei* form I O-antigen in the wzz– Ty21a-Sso (clone #3-1) and wzz+ Ty21a-Sso (clone #9-26) strains was examined. By Western blot analyses, both clones expressed *S. sonnei* form I O-antigen (FIG. 3A) at comparable levels. Similar to [19], the majority of the form I O-antigen was expressed in the form of group 4 capsule, although a low level of LPS form was detected. Despite the expression of *S. sonnei* form I O-antigen on the cell surface, the expression of *Salmonella* groups O9, 12-antigen from the two Ty21a-Sso strains were shown to be of similar levels as compared to that of Ty21a (FIG. 3B). O-antigen expression was further visualized by immunofluorescence assay (IFA). The results showed that with Ty21a (FIG. 3C, *Salmonella* groups 9 and 12 O-antigens only) and *S. sonnei* (FIG. 3D, form I O-antigen only) the antibodies were specific and the native O-antigens are expressed uniformly on the cell surface. Both Ty21a-Sso (clone #3-1) and Ty21a-Sso (clone #9-26) expressed both *Salmonella* groups O9, 12-antigen and *S. sonnei* form I O-antigen on the cell (FIGS. 3E, 3F). Of note, both Ty21a-Sso (clone #3-1) and Ty21a-Sso (clone #9-26) expressed *S. sonnei* form I O-antigen at 100% of cells examined. However, the morphology of the expressed *S. sonnei* form I O-antigen was slightly different. In the wzz– Ty21a-Sso (clone #3-1) strain, *S. sonnei* form I O-antigen often appeared as non-homogeneous, punctuated dots on cell surface (FIG. 3E). On the other hand, *S. sonnei* form I O-antigen showed a much more uniformed expression in the wzz+ Ty21a-Sso (clone #9-26) (FIG. 3F). Similarly, uniformed expression was also observed from another independently generated wzz+Ty21a-Sso clone (data not shown). These results show that *S. sonnei* wzz contributes to the even distribution of *S. sonnei* O-antigen along cell surface. Co-expression of wzz in Ty21a might also help the cell present *S. sonnei* form I O-antigen in a manner more similar to the native form I O-antigen.

Example 3

Stable Integration and Expression of Acid Resistance Genes in Ty21a to Enhance Cell Viability AR genes were expressed in Ty21a vaccine candidates to enhance cell viability at low pH in the stomach, thereby augmenting its immunogenicity and protective efficacy. Expression of the AR2 genes gadA, gadB, and gadC in *E.* coli and Shigella is under a series of complex regulation and that of ybaS has yet to be characterized. Activation of the AR2 pathway is dependent on the alternative sigma factor, rpoS, which is mutated and only partially functional in Ty21a.

The arabinose-controlled promoter, $P_{ara}$, which responds quickly to the inducer and the activated arabinose-bound transcription factor AraC activates robust gene transcription, was used in the constructs generated in this Example.

The AraC-$P_{ara}$-S. flexneri GadABC cassette was integrated into the vi locus of Ty21a chromosome, replacing the tviE ORF, using the recombineering technology. The final, marker-less, clone was designated Ty21a-ABC (clone #2-2) and the integrated sequence was confirmed by genomic PCR. To confirm that the integrated genes were expressed and enzymatically active, Ty21a-ABC (clone #2-2) was subjected to a modified GAD assay, in which the Triton X-100 was omitted from the original GAD reagent one [45]. In the absence of Triton X-100, the cell remains intact and only a functional GadC can transport glutamate into the cell. Therefore, the modified GAD assay tests simultaneously both the ability of GadA and/or GadB to decarboxylate glutamate and the ability of GadC to transport the substrate.

Bromocresol green in the GAD reagent served as a pH indicator. Cells from culture were resuspended in the modified GAD reagent and reactions that turned greenish-blue in color were scored as GAD+. Ty21a, Ty21a-ABC (clone #2-2), and *S. sonnei* 53G form II were grown in TSB or TSB supplemented with 1% trehalose (Tre) and/or 0.75% arabinose (Ara) at 37° C. with aeration overnight. *Salmonella* and *Shigella* produced alkalinic byproducts in TSB; and the overnight culture was around pH 8. Tre and Ara supported acid fermentation of *Shigella*; and Tre supported acid fermentation of *Salmonella* without inhibiting $P_{ara}$ activity through catabolite repression. The resulting saturating culture was moderately acidic, at around pH 5.5. Ty21a did not encode a GAD enzyme and was GAD− in all culture conditions (FIG. 4, upper panel). Native gadA, gadB, and gadC genes in *Shigella* were quickly induced by acid. The GAD activity in *S. sonnei* 53G was positive for all culture conditions but cells from TSB alone showed lower activity (FIG. 4, middle panel). GAD activity of Ty21a-ABC (clone #2-2) was greatly induced by Ara, and the presence of Tre did not inhibit it (FIG. 4, bottom panel). Ty21a-ABC (clone #2-2) grown in TSB or TSB+Tre turned slightly GAD+, indicating low levels of leaky expression. The integrated transgenes were expressed and enzymatically active in Ty21a-ABC (clone #2-2) in a controlled manner.

Example 4

Stable Integration and Expression of Glutaminase Gene ybaS in Ty21a to Further Enhance Cell Viability Database search revealed that *Shigella* genome encodes a highly conserved ybaS gene, with only 2 out of 310 amino acids of the *S. sonnei* YbaS different from the *E. coli* YbaS enzyme. To construct a concerted glutaminase-GAD AR system, the CDS of ybaS was cloned from *S. sonnei* genomic DNA to replace that of gadA in the AraC-$P_{ara}$-GadABC cassette and integrated the resulting AraC-$P_{ara}$-YbaS-GadBC cassette into Ty21a chromosome using recombineering technology. The resulting final, marker-less, strain was designated as Ty21a-YBC (clone #1-28). Gene integration at the DNA level was confirmed by genomic PCR and enzymatic activities of the transgenes were confirmed by the modified GAD (FIG. 5A) and glutaminase (FIG. 5B) assays. Ty21a-YBC (clone #1-28) expressed both GAD and glutaminase activities induced by arabinose, while Ty21a-ABC (clone #2-2) only exhibited arabinose-induced GAD but not glutaminase activity. The negative control Ty21a expressed none, while the positive control *S. sonnei* form II expressed both enzymes and did not need arabinose to induce expression.

Example 5

Construction of an Acid Resistant Ty21a Expressing *S. sonnei* Form I O-Antigen A Ty21a-Sso strain that is acid resistant was constructed. Because the size of an insert containing both the AR cassette and *S. sonnei* form I O-antigen gene cluster is too large for PCR-amplification, the acid resistant Ty21a-Sso strains were generated by stably integrating the wzz+ *S. sonnei* form I O antigen expression cassette into the chromosome of Ty21a-ABC (clone #2-2) and Ty21a-YBC (clone #1-28) using gadC and vexA as homologous sequences for recombination. The resulting final, marker-less, strains were designated as Ty21a-ABC-Sso (clone #20-25) and Ty21a-YBC-Sso (clone #34-1).

Because the arabinose-induced AR genes are upstream to the *S. sonnei* form I O antigen gene cluster, it was determined whether the presence of arabinose affects O-antigen expression. Strains were grown overnight in the absence or presence of 1% arabinose and 0.75% arabinose and the saturating cultures were visualized at single cell level using IFA (FIG. 6). When arabinose was present in the culture medium, *S. sonnei* form I O antigen expressed on Ty21a-ABC-Sso (clone #20-25) exhibited a punctuated pattern similar to that from the wzz− Ty21a-Sso (clone #3-1). On the other hand, expression of *S. sonnei* form I O antigen in Ty21a-YBC-Sso (clone #34-1) was not affected by arabinose; the cell displayed uniformed form I O antigen on cell surface morphologically similar to that from *S. sonnei* form I and the wzz+ Ty21a-Sso (clone #9-26) in the presence and absence of arabinose. Based on this morphological advantage, Ty21a-YBC-Sso (clone #34-1) was further tested as a candidate vaccine strain.

Example 6

Ty21a-YBC-Sso is Acid Resistant

The ability of Ty21a-YBC-Sso (clone #34-1) to survive at pH 2.5 was tested. Although Tre is not required for transgene expression, *Salmonella* needs acid fermentation to induce ATR, a prerequisite for acid resistance. Bacterial strains were grown in TSB+Tre+Ara with agitation to stationary phase and the strains showed the expression pattern of glutaminase and GAD activities shown in FIG. 7A. Cultures were diluted 1:20 in acid medium at pH 2.5 in the presence of 1.5 mM glutamine. Cultures were grown at 37° C. with agitation and viability was examined at the indicated time point (FIG. 7B). *S. sonnei* 53G form II maintained ~100% viability after 1 hr incubation at pH 2.5 (black squares) and ~50% of the cells were still viable after 2 hr (data not shown). In contrast, Ty21a and Ty21a-Sso (clone #9-26) survived poorly at low pH. Cell viability was reduced by ~$10^3$-fold for Ty21a at 15 min and >$10^7$-fold by 30 min (gray circles). Cell viability was further reduced in Ty21a-Sso (clone #9-26), with no viable colony recovered even after 15 min exposure to acid at pH 2.5, equivalent to a >$10^8$-fold reduction in viability (gray open triangles). Synthesis of the form I O-antigen may impose metabolic burden to the cell. Ty21a-YBC (clone #1-28) maintained greater than 50% viability at 30 min and ~10% at 45 min (black squares). However, the viability dropped to ~1% at 1 hr and no viable colony was recovered after 2 hr (data not shown). Ty21a-YBC-Sso (clone #34-1) exhibited similar acid resistance as Ty21a-YBC (clone #1-28) at 30 min, maintaining ~50% viability. However, the cell viability quickly deteriorated, with ~1% and ~$10^{-5}$ of cells viable at 45 min and 1 hr, respectively (black open triangles). Increasing concentrations of glutamine in acid medium improved Ty21a-YBC-Sso (clone #34-1) survival. With 6 mM glutamine in the pH 2.5 medium, cell survival at 1 hr improved to ~0.1%, and, at 12 mM and 20 mM glutamine, nearly 1% and 10% of cells remained viable after 1 hr at pH 2.5 (FIG. 8). The ability of Ty21a-YBC (clone #1-28) and Ty21a-YBC-Sso (clone #34-1) vaccine strains to survive low pH was inferior to $S.$ $sonnei$, however both strains expressed comparable levels GAD and glutaminase activities to that in $S.$ $sonnei$. This result suggests that the AR system alone is necessary but insufficient to support acid resistance of Ty21a. These results showed that expression of the concerted glutaminase-GAD AR system improved acid resistance and cell viability.

Example 7

Immunogenicity of Ty21a-Sso in Mice 10 mice were immunized intraperitoneally with 3 doses of Ty21a-Sso (clone #3-1), 5×$10^7$ CFU/mouse at 2-week intervals. Two weeks after the $3^{rd}$, high levels of serum IgG antibodies against both $S.$ $sonnei$ form I O-antigen and $S.$ $Typhi$ groups 9, 12 O-antigen by ELISA at OD 1.0, with geometric mean titers at 666,151 (range 360,341-1,111,200) and 2,103 (range 755-3,529), respectively, were detected in the mice. In comparison, a pooled serum obtained from mice immunized with a Ty21a strain containing an irrelevant antigen (Ty21a-PA-01) through the same dose regimen and immunization route produced negligible anti-$S.$ $sonnei$ serum IgG antibodies (ELISA OD 1.0 titer was $10^6$) but comparable levels of anti-$S.$ $Typhi$ antibodies (ELISA OD 1.0 titer was 2,864) (FIGS. 9A-9B).

To assess if Ty21a-Sso is immunogenic when introduced via the mucosal route, and to compare the wzz– strain Ty21a-Sso (clone #3-1) and the wzz+ strain Ty21a-Sso (clone #9-26), three groups of 20 mice were immunized intranasally with 4 doses of 1×$10^9$ CFU/mouse Ty21a, Ty21a-Sso (clone #3-1), and Ty21a-Sso (clone #9-26) at 2-week interval. 2 weeks after the $3^{rd}$ and the $4^{th}$ doses, sera were collected and serum IgG levels assessed by ELISA at OD 1.0. The Ty21a vector control induced serum IgG antibodies against $S.$ $sonnei$ form I O-antigen at a level similar to that of Ty21a-PA-01 (FIG. 10A), with the geometric mean titers of 340 (range 23-5,823) and 523 (range 48-3,393) for the $3^{rd}$ and $4^{th}$ dose, respectively, as compared to 106. Both Ty21a-Sso (clone #3-1) and Ty21a-Sso (clone #9-26) induced serum IgG antibodies at a significantly higher level than the Ty21a control, with geometric mean ELISA OD 1.0 titers at 6,321 (range 1,730-14,776) and 6,429 (range 611-20,451) after the $3_{rd}$ dose, and 1,815 (range 511-8839) and 2,200 (range 317-7,218) after the $4^{th}$ dose, respectively. The antibody levels were higher than that from a previously published LPS-protein conjugated vaccine candidate, which showed protection against $S.$ $sonnei$ infection in guinea pigs [20]. The present results showed that Ty21a-Sso induced mucosal immune responses.

Example 8

Recombinant Ty21a-Ss s Vaccine Strain Maintains Stable Expression of $S.$ $sonnei$ Form I O-Antigen for Up to 200 Generations A genetic seedbank was generated for the vaccine strain Ty21a-Sso (clone #9-26). Characterization of the Ty21a-Sso seedbank and the specification are as listed in Table II. Two random vials from the seed bank were characterized as previously published [50]. Ty21a (Vivotif), $S.$ $enterica$ serovar $Typhi$ strain Ty2, and $E.$ $coli$ strain HB101 were controls. All microbiological, biochemical, immunological, and genetic properties examined were as expected. The stability of the $S.$ $sonnei$ form I O-antigen expression in Ty21a-Sso was also examined (FIG. 11). Cells were grown under non-selective conditions for a total of 200 generations. 100 colonies from each culture were plated onto a TSA plate, transferred to a nitrocellulose membrane, and analyzed for $S.$ $sonnei$ form I O-antigen expression by colony immunoblot. All of 100 colonies of Ty21a-Sso (clone #9-26) tested retained $S.$ $sonnei$ form I O-antigen expression, demonstrating 100% stability of the chromosomally integrated genes even after 200 generations of growth. Characterization of Ty21a-Sso seed bank showed that all properties of the strain are as expected and the $S.$ $sonnei$ form I O-antigen remained stably expressed in 100% of the colonies after 200 generations of growth. The bacterium was grown at high dilution in TSB for ~24 h, which represents ~25 generation of growth. Each culture was serially diluted to ~100 CFU/ml and grown for an additional 24 h, for a total of 150 generations. The resulting cells from that point were plated on TSA, grown overnight at 37° C. (another ~25 generations), and 100 individual colonies were patched onto a new TSA plate for growth overnight at 37° C. The resulting colonies from agar plates, which have gone through a total of 200 generations of growth, were transferred to a nitrocellulose membrane and analyzed by standard immunoblotting procedures using rabbit polyclonal antisera against $S.$ $sonnei$ form I.

Example 9

Immunogenicity of Recombinant Ty21a-Sso and Ty21a-YBC-Sso Vaccine Strains in Mice To assess the immunogenicity of Ty21a-Sso (clone #9-26) and Ty21a-YBC-Sso (clone #34-1) administered through a mucosal route, four groups of 10 mice were immunized intranasally with 4 doses of 1×$10^9$ CFU of Ty21a, Ty21a-Sso (clone #9-26), Ty21a-YBC-Sso (clone #34-1, AR gene not expressed under this condition), and Ty21a-YBC-Sso clone (#34-1) grown in the presence of trehalose and arabinose (AR genes activated; thereafter referred to Ty21a-YBC-Sso+ARA) at 2-week intervals. Serum samples were obtained at 2 weeks after doses 2, 3, 4 and serum IgG antibody responses were assessed by ELISA.

For mice immunized with Ty21a, the geometric mean OD 1.0 (serum dilution at which the optical density was 1.0) titers (GMT) of anti-$S.$ $sonnei$ form I O-antigen antibodies were 2.5 (range 1-16), 6.9 (range 1-37), and 62.8 (range 1-149) after 2, 3, and 4 doses of immunization, respectively (FIG. 12, squares). These values were not statistically different from that obtained from naïve mice of the same age, with GMTs at 2.0 (range 1-30), 34.6 (range 18-54), 80.3 (range 43-207) (FIG. 12, circles). In contrast, mice immunized with Ty21a-Sso (FIG. 12, triangles), Ty21a-YBC-Sso (FIG. 12, diamonds), and Ty21a-YBC-Sso (FIG. 12, inverted triangles) produced significantly higher serum IgG titers of anti-*S. sonnei* form I O-antigen, and the titers were progressively higher with increasing number of immunizations (p<0.05 by Wilcoxon Rank Sum test). All mice received $1 \times 10^9$ CFU. For example, at 2 weeks after dose 4, the GMTs to *S. sonnei* form I O-antigen of mice immunized with Ty21a-Sso, Ty21a-YBC-Sso, and Ty21a-YBC-Sso+ARA were 7,909.5 (range 2,560-21,700), 7,202.4 (range 3,363-15,910), and 23,020.8 (range 8,521-71,575), respectively. Sera were collected 2 weeks after doses 2, 3, 4 and antibody responses to extracted *S. sonnei* LPS were measured by ELISA OD 1.0. Sera from 5 un-immunized, naïve mice (circles) of the same age were also collected and measured as negative controls. Each point represents an individual mouse and the intensity of the point indicated whether the mouse was protected (dark) or unprotected (light) from the challenge. The GMT for each group is indicated by a horizontal bar.

Example 10

Serum Antibody Responses to *Salmonella* Groups O 9, 12-Antigens

The serum antibody responses to *Salmonella* groups O 9, 12-antigens, the native O-antigens expressed on Ty21a surface that induced protective immunity against typhoid fever were also examined (FIG. 13). Ty21a-Sso and Ty21a-YBC-Sso immunized through mucosal route generated high antibody responses to Ty21a O-antigens. Sera from mice immunized with Ty21a (squares), Ty21a-Sso (triangles), Ty21a-YBC-Sso (diamonds), Ty21a-YBC-Sso+ARA (inverted triangles), or naïve mice of the same age (circles) were collected 2 weeks after doses 2, 3, 4 and antibody responses to extracted Ty21a LPS (*Salmonella* groups 9, 12 O-antigens) were measured by ELISA OD 1.0. Each point represents an individual mouse and the intensity of the point indicated whether the mouse was protected (dark) or unprotected (light) from a lethal *S. sonnei* 53G form I challenge. The GMT for each group is indicated by a horizontal bar.

For mice immunized with Ty21a, the geometric mean titers of anti-*Salmonella* groups 9,12 O-antigens serum IgG were 53.9 (range 1-864), 54.5 (range 1-545), and 328.3 (range 72-2,295) at 2 weeks after doses 2, 3, and 4, respectively (FIG. 13, squares). We observed that Ty21a-Sso (FIG. 13, triangles), Ty21a-YBC-Sso (FIG. 13, diamonds), and Ty21a-YBC-Sso+ARA (FIG. 13, inverted triangles) induced anti-*Salmonella* groups 9, 12 O-antigen serum IgG at comparable levels. At 2 weeks after dose 4, the GMTs were 421.6 (range 98-1,241), 182.3 (range (74-1,030), and 426.8 (range 78-2,539) for Ty21a-Sso, Ty21a-YBC-Sso, and Ty21a-YBC-Sso+ARA. These antibody levels were significantly higher than that from the naïve mice (FIG. 13, circles), with a GMT of 13.6 (range 1-38).

Example 11

Ty21a-Sso and Ty21a-YBC-Sso Protected Mice from Lethal *S. sonnei* 53G I Infection The immunized mice described in Example 9 were challenged six weeks after dose 4 with a lethal infection of *S. sonnei* 53G form I by intranasal instillation ($1.2 \times 10^9$ CFU— approximately 120 LD50) and monitored daily for 14 days. Only 3 out of 9 mice immunized with Ty21a (FIG. 14, solid line) survived the challenge, while 7/10, 9/10, and 9/10 mice immunized with Ty21a-Sso (FIG. 14, dashed line), Ty21a-YBC-Sso (FIG. 14, dotted line), and Ty21a-YBC-Sso+ARA (FIG. 14, dot-dash line) survived and remained healthy throughout the 14-day monitoring period. The difference was statistically significant (p=0.0211 by Fishers Exact test) and the protective efficacy was 55.2%, 85.1%, and 85.1% for Ty21a-Sso, Ty21a-YBC-Sso, and Ty21a-YBC-Sso+ARA, respectively.

REFERENCES

1. Bryce, J., et al., *WHO estimates of the causes of death in children*. Lancet, 2005. 365(9465): p. 1147-52.
2. Bardhan, P., et al., *Decrease in shigellosis-related deaths without Shigella spp.-specific interventions, Asia*. Emerging Infectious Diseases, 2010. 16(11): p. 1718-23.
3. Livio, S., et al., *Shigella Isolates From the Global Enteric Multicenter Study Inform Vaccine Development*. Clin Infect Dis, 2014.
4. Scallan, E., et al., *Foodborne illness acquired in the United States-major pathogens*. Emerg Infect Dis, 2011. 17(1): p. 7-15.
5. Bowen, A., et al., *Notes from the Field: Outbreaks of Shigella sonnei Infection with Decreased Susceptibility to Azithromycin Among Men Who Have Sex with Men—Chicago and Metropolitan Minneapolis-St. Paul. 2014*. MMWR Morb Mortal Wkly Rep, 2015. 64(21): p. 597-8.
6. Howie, R. L., et al., *Reduced azithromycin susceptibility in Shigella sonnei, United States*. Microb Drug Resist, 2010. 16(4): p. 245-8.
7. Sjolund Karlsson, M., et al., *Outbreak of infections caused by Shigella sonnei with reduced susceptibility to azithromycin in the United States*. Antimicrob Agents Chemother, 2013. 57(3): p. 1559-60.
8. Gu, B., et al., *Comparison of the prevalence and changing resistance to nalidixic acid and ciprofloxacin of Shigella between Europe-America and Asia-Africa from 1998 to 2009*. Int J Antimicrob Agents, 2012. 40(1): p. 9-17.
9. Robbins, J. B., C. Chu, and R. Schneerson, *Hypothesis for vaccine development: protective immunity to enteric diseases caused by nontyphoidal salmonellae and shigellae may be conferred by serum IgG antibodies to the O-specific polysaccharide of their lipopolysaccharides*. Clin Infect Dis, 1992. 15(2): p. 346-61.
10. Kopecko, D. J., et al., *Genetic stability of vaccine strain Salmonella Typhi Ty21a over 25 years*. Int J Med Microbiol, 2009. 299(4): p. 233-46.
11. Levine, M. M., *Typhoid fever vaccines*, in *Vaccines*, S. A. Plotkin and W. A. Orenstein, Editors. 1999, W. B. Saunders: Philadelphia. p. 781-814.
12. Levine, M. M., et al., *Duration of efficacy of Ty21a, attenuated Salmonella typhi live oral vaccine*. Vaccine, 1999. 17 Suppl 2: p. S22-7.
13. Wahdan, M. H., et al., *A controlled field trial of live Salmonella typhi strain Ty 21a oral vaccine against typhoid: three-year results*. Journal of Infectious Diseases, 1982. 145(3): p. 292-5.
14. Gilman, R. H., et al., *Evaluation of a UDP-glucose-4-epimeraseless mutant of Salmonella typhi as a liver oral vaccine*. J Infect Dis, 1977. 136(6): p. 717-23.
15. Cryz, S. J., Jr., *Post-marketing experience with live oral Ty21a vaccine*. Lancet, 1993. 341(8836): p. 49-50.

16. Simanjuntak, C. H., et al., *Oral immunisation against typhoid fever in Indonesia with Ty21a vaccine.* Lancet, 1991. 338(8774): p. 1055-9.
17. Levine, M. M., et al., *Development of vaccines and drugs against diarrhea:* 11th Nobel Conference, Stockholm, 1985, in 11th Noble Conference, J. Holmgren, A. Lindberg, and R. Möllby, Editors. 1986, Student lilteratur, Lund, Sweden: Stockholm. p. 90-101.
18. Ohtake, S., et al., *Room temperature stabilization of oral, live attenuated Salmonella enterica serovar Typhi-vectored vaccines.* Vaccine, 2011. 29(15): p. 2761-71.
19. Dharmasena, M. N., et al., *Stable Expression of Shigella sonnei Form I O-Polysaccharide Genes Recombineered into the Chromosome of Live Salmonella Oral Vaccine Vector Ty21a.* International Journal of Medical Microbiology, 2013. 303(3): p. 105-13.
20. Pickett, T. E., et al., *In vivo characterization of the murine intranasal model for assessing the immunogenicity of attenuated Salmonella enterica serovar Typhi strains as live mucosal vaccines and as live vectors.* Infect Immun, 2000. 68(1): p. 205-13.
21. Lin, J., et al., *Comparative analysis of extreme acid survival in Salmonella typhimurium, Shigella flexneri, and Fscherichia coli.* Journal of Bacteriology, 1995. 177 (14): p. 4097-104.
22. Gorden, J. and P. L. Small, *Acid resistance in enteric bacteria.* Infect Immun, 1993. 61(1): p. 364-7.
23. Audia, J. P., C. C. Webb, and J. W. Foster, *Breaking through the acid barrier: an orchestrated response to proton stress by enteric bacteria.* International Journal of Medical Microbiology, 2001. 291(2): p. 97-106.
24. Foster, J. W., *Salmonella acid shock proteins are required for the adaptive acid tolerance response.* J Bacteriol, 1991. 173(21): p. 6896-902.
25. Foster, J. W., *The acid tolerance response of Salmonella typhimurium involves transient synthesis of key acid shock proteins.* J Bacteriol, 1993. 175(7): p. 1981-7.
26. Foster, J. W., *Low pH adaptation and the acid tolerance response of Salmonella typhimurium.* Crit Rev Microbiol, 1995. 21(4): p. 215-37.
27. Robbe-Saule, V. and F. Norel, *The rpoS mutant allele of Salmonella typhi Ty2 is identical to that of the live typhoid vaccine Ty21a.* FEMS Microbiol Lett, 1999. 170(1): p. 141-3.
28. Germanier, R. and E. Fuer, *Isolation and characterization of Gal E mutant Ty 21a of Salmonella typhi: a candidate strain for a live, oral typhoid vaccine.* Journal of Infectious Diseases, 1975. 131(5): p. 553-8.
29. Hone, D. M., A. M. Harris, and M. M. Levine, *Adaptive acid tolerance response by Salmonella typhi and candidate live oral typhoid vaccine strains.* Vaccine, 1994. 12(10): p. 895-8.
30. Kantele, A., et al., *Comparison of the human immune response to live oral, killed oral or killed parenteral Salmonella typhi TY21A vaccines.* Microb Pathog, 1991. 10(2): p. 117-26.
31. Waterman, S. R. and P. L. Small, *Identification of the promoter regions and sigma(s)-dependent regulation of the gadA and gadBC genes associated with glutamate-dependent acid resistance in Shigellaflexneri.* FEMS Microbiology Letters, 2003. 225(1): p. 155-60.
32. Bhagwat. A. A. and M. Bhagwat, *Comparative analysis of transcriptional regulatory elements of glutamate-dependent acid-resistance systems of Shigella flexneri and Escherichia coli O157:H7.* FEMS Microbiology Letters, 2004. 234(1): p. 139-47.
33. Lin, J., et al., *Mechanisms of acid resistance in enterohemorrhagic Escherichia coli.* Appl Environ Microbiol, 1996. 62(9): p. 3094-100.
34. Brenneman, K. E., et al., *Low-pH rescue of acid-sensitive Salmonella enterica Serovar Typhi Strains by a Rhamnose-regulated arginine decarboxylase system.* J Bacteriol, 2013. 195(13): p. 3062-72.
35. De Biase, D. and E. Pennacchietti, *Glutamate decarboxylase-dependent acid resistance in orally acquired bacteria: function, distribution and biomedical implications of the gadBC operon.* Mol Microbiol, 2012. 86(4): p. 770-86.
36. Merrell, D. S. and A. Camilli, *Acid tolerance of gastrointestinal pathogens.* Curr Opin Microbiol, 2002. 5(1): p. 51-5.
37. Zhao, B. and W. A. Houry, *Acid stress response in enteropathogenic gammaproteobacteria: an aptitude for survival.* Biochem Cell Biol, 2010. 88(2): p. 301-14.
38. Hersh, B. M., et al., *A glutamate-dependent acid resistance gene in Escherichia coli.* J Bacteriol, 1996. 178(13): p. 3978-81.
39. Smith, D. K., et al., *Escherichia coli has two homologous glutamate decarboxylase genes that map to distinct loci.* J Bacteriol, 1992. 174(18): p. 5820-6.
40. Lu, P., et al., *L-glutamine provides acid resistance for Escherichia coli through enzymatic release of ammonia.* Cell Res, 2013. 23(5): p. 635-44.
41. Ma, D., et al., *Structure and mechanism of a glutamate-GABA antiporter.* Nature, 2012. 483(7391): p. 632-6.
42. Kopecko, D. J., O. Washington, and S. B. Formal, *Genetic and physical evidence for plasmid control of Shigella sonnei form I cell surface antigen.* Infect Immun, 1980. 29(1): p. 207-14.
43. Datsenko, K. A. and B. L. Wanner, *One-step inactivation of chromosomal genes in Escherichia coli K-12 using PCR products.* Proc Natl Acad Sci USA, 2000. 97(12): p. 6640-5.
44. Cherepanov, P. P. and W. Wackernagel, *Gene disruption in Escherichia coli: TcR and KmR cassettes with the option of Flp-catalyzed excision of the antibiotic-resistance determinant.* Gene, 1995. 158(1): p. 9-14.
45. Rice, E. W., et al., *Rapid glutamate decarboxylase assay for detection of Escherichia coli.* Appl Environ Microbiol, 1993. 59(12): p. 4347-9.
46. Xu, D. Q., et al., *Molecular cloning and characterization of genes for Shigella sonnei form I O polysaccharide: proposed biosynthetic pathway and stable expression in a live salmonella vaccine vector.* Infect Immun, 2002. 70(8): p. 4414-23.
47. Shepherd, J. G., L. Wang, and P. R. Reeves, *Comparison of O-antigen gene clusters of Escherichia coli (Shigella) sonnei and Plesiomonas shigelloides O17: sonnei gained its current plasmid-borne O-antigen genes from P. shigelloides in a recent event.* Infect Immun, 2000. 68(10): p. 6056-61.
48. Vivotif [package insert-USA]. Crucell Switzerland LTD; September 2013. worldwideweb.fda.gov/downloads/ http://www.fda.gov/downloads/BiologicsBloodVaccines/ Vaccines/ApprovedProducts/UCM142807.pdf.
49. Curtiss, III, R., et al., *Attenuated live bacteria with increased acid resistance and methods of use thereof.* U.S. Patent Publication US2014/0370057 A1, pub. Dec. 18, 2014.
50. Kopecko, D. J., et al., *Genetic stability of vaccine strain Salmonella Typhi Ty21a over 25 years.* Int J Med Microbiol, 2009. 299(4): p. 233-46.

Tables

TABLE I

Bacterial strains and plasmids used in this study

| Strain or plasmid | Description | Reference or source |
|---|---|---|
| Bacterial strains | | |
| *E. coli* NEB5α | cloning | New England Biolabs |
| *Salmonella enterica* serovar Typhi Ty21a | | [14, 48] |
| Ty21a-Sso (wzz−), clone #3-1 (SEQ ID NO: 3) | Ty21a with a chromosomally integrated *S. sonnei* form I O antigen gene cluster at the tviE locus. The first 495 bp of wzz gene is absent. | This study |
| Ty21a-Sso wzz+, clone #9-26 (SEQ ID NO: 4) | Ty21a with a chromosomally integrated *S. sonnei* form I O antigen gene cluster at the tviE locus. Full-length wzz gene and its 100 bp upstream sequence are present. | This study |
| Ty21a-ABC, clone #2-2 (SEQ ID NO: 2) | Ty21a with a chromosomally integrated *S. flexneri* 2a GadA, GadB, and GadC genes under arabinose promoter at the tviE locus | This study |
| Ty21a-YBC, clone #1-28 (SEQ ID NO: 1) | Ty21a with a chromosomally integrated *S. sonnei* YbaS, *S. flexneri* 2a GadB and GadC under arabinose promoter at the tviE locus | This study |
| Ty21a-ABC-Sso, clone #20-25 (SEQ ID NO: 5) | Ty21a with a chromosomally integrated *S. flexneri* 2a GadA, GadB, and GadC genes under arabinose promoter followed by *S. sonnei* form I O antigen gene cluster with full-length wzz at the tviE locus | This study |
| Ty21a-YBC-Sso, clone #34-1 (SEQ ID NO: 6) | Ty21a with a chromosomally integrated *S. sonnei* YbaS, *S. flexneri* 2a GadB, and GadC genes under arabinose promoter followed by *S. sonnei* form I O antigen gene cluster with full-length wzz at the tviE locus | This study |
| *Shigella sonnei* 53G I | Form I (Phase I), virulent isolate | [42] |
| *Shigella sonnei* 53G II | Form II (Phase II), avirulent isolate | [42] |
| Plasmids | | |
| pUC19 | Cloning vector | New England Biolabs |
| pMDTV | Low copy pGB2 vector with inserts of tviD and vexA sequences from Ty21a, separated by FRT-flanked kanamycin resistance gene (KanR) | [19] |
| pKD46 | Temperature sensitive plasmid with bacteriophage λ genes Redα, Redβ, and Redγ expressed under the control of the arabinose-inducible promoter ($P_{ara}$). Used for genetic recombineering. | [43] |
| pCP20 | Temperature sensitive plasmid carrying a constitutively expressed yeast flip recombinase (FLP). Used to remove KanR marker. | [44] |
| pMDTV::Sso O Ag (wzz−) | DNA template for construction of Ty21a-Sso (wzz−) | This study |
| pMDTV::Sso O Ag wzz+ | DNA template for construction of Ty21a-Sso (wzz+) | This study |
| pUC19::AraC-GadABC-KanR-VexA | DNA template for construction of Tyr21a-ABC | This study |
| pUC19::AraC-YadC-GadBC-KanR-VexA | DNA template for construction of Ty21a-YBC | This study |
| pTIKV::AraC-YadC-GadBC-Sso O Ag wzz+ | DNA template for construction of Ty21a-ABC-Sso and Ty21a-YBC-Sso | This study |

TABLE II

Characterization of the Ty21a-Sso seedbank

| Assay | Method | Vial 1 | Vial 2 | Ty21a | Ty2 |
|---|---|---|---|---|---|
| Microbiological | API 20 E | *S. typhi* | *S. typhi* | *S. typhi* | *S. typhi* |
| | Galactose fermentation (Colony appearance on Bromothymol Blue agar + 1% galactose) | Blue | Blue | Blue | Yellow |
| Biochemical | Minimal media + cysteine + tryptophan | No growth | No growth | No growth | Growth |
| | Minimal media + cysteine + tryptophan + valine + isoleucine | Growth | Growth | Growth | Growth |
| | Heat stress at 55° C. for 20 min | Sensitive | Sensitive | Sensitive | Resistant |
| | Oxidative stress in 0.3% $H_2O_2$ for 20 min | Sensitive | Sensitive | Sensitive | Resistant |
| | Galactose (1%)-induced bacteriolysis | Sensitive | Sensitive | Sensitive | Resistant |
| Immunological | *Salmonella* group 9,12 O-antigen agglutination | + | + | + | + |
| | Vi antigen agglutination | − | − | − | + |
| | *S. sonnei* O-Ag Expression (Colony and Western blot) at 200 generations | + | + | − | ND |

TABLE II-continued

| Characterization of the Ty21a-Sso seedbank | | | | | |
|---|---|---|---|---|---|
| Assay | Method | Vial 1 | Vial 2 | Ty21a | Ty2 |
| Genetic | 16S rDNA sequence | Identical to Ty21a | Identical to Ty21a | Ty21a | Ty2 |
| | galE DNA sequence | Identical to Ty21a | Identical to Ty21a | Ty21a (T367C; C442Δ | Ty2 (wild type |
| | Chromosomally integrated *S. sonnei* form I O-Ag gene cluster (PCR) | + | + | − | − |

SEQUENCE LISTING (6 sequences)

SEQ ID NO: 1 - DNA, 4795536 bp, Artificial Sequence (residues 1-1,598,512 of 4,795,536)
  Ty21a-YBC, clone #1-28
agagattacgtctggttgcaagagatcataacaggggaaattgattgaaaataaatatatcgccagcagcacatgaacaagtttcggaatgtgatcaatttaaaaatttattgacttaggcgggcagatactttaaccaatataggaatacaagacagacaaataaaaatgacagagtacacaacatccatgaaccgcatcagcaccaccaccattaccaccatcaccattaccacaggtaacggtgcgggctgacgcgtacaggaaacacagaaaaaagcccgcacctgaacagtgcgggcttttttttcgaccagagatcacgaggtaacaaccatgcgagtgttgaagttcggcggtacatcagtggcaaatgcagaacgttttctgcgtgttgccgatattctggaaagcaattccaggcaagggcaggtagcgaccgtactttccgcccccgcgaaaattaccaaccatctggtggcgatgattgaaaaaactatcggcggccaggatgctttgccgaatatcagcgatgccgaacgtattttttctgacctgctcgcaggacttgccagcgcgcagccgggattcccgcttgcacggttgaaaatggttgtcgaacaagaattcgctcagatcaaacatgttttgcatggtatcagcctgctgggtcagtgcccggatagcatcaacgccgcgctgatttgccgtggcgaaaaaatgtcgatcgcgattatggcgggactcctggaggcgcgtggacatcgcgtcacggtgatcgatccggtagaaaaactgctggcggtgggccattaccttgaatctaccgtcgatatcgcggaatcgactcgccgtatcgccgccagccagatcccggccgatcacatgatcctgatggcgggctttactgccggtaatgaaaagggtgaactggtggtgctgggccgtaatggttccgactattccgccgccgtgctggccgcctgtttacgcgctgactgctgtgaaatctggactgacgtcgatggcgtgtatacctgtgacccgcgccaggtgccggacgccaggctgttgaaatcgatgtcctaccaggaagcgatggagctctcttacttcggcgctaaagtccttcaccctcgcaccataacgcctatcgcccagttccagatcccctgtctgattaaaaataccggcaatccgcaggcgccaggaacgctgatcggcgcgtccagcgacgatgataatctgccggttaaagggatctctaaccttaacaacatggcgatgtttagcgtctccggcccgggaatgaaagggatgattgggatggcggcgcgtgttttcgccgccatgtctcgcgccgggatctcggtggtgctcattacccagtcctcctctgagtacagcatcagcttctgtgtgccgcagagtgactgcgcgcgtgcccgccgtgcgatgcaggatgagttctatctggagctgaaagaggggctgctggagccgctggcggttacggagcggttggcgattatctctgttgtcggcgacggtatgcgcacgctacgcggcatttcagcgaaattcttcgccgcgctggcgcgggctaatatcaatatcgtggcgatcgctcagggatcttctgagcgttccatttctgtggtggtgaataacgacgatgccaccaccggcgtgcgggtaacgcaccagatgctgttcaataccgatcaggtgattgaagtgtttgtcattggcgtcggcggcgtcggcggcgcgctactggaacagcttaaacgtcagcaaacctggctgaagaacaagcacatcgatctacgcgtgtgcggcgtggcgaactcaaaggcgttgctaaccaatgtgcatggcctgaatctggacaactggcaggcggaactggcgcaagcgaacgcgccgttcaatctgggacgtttaattcgcctggtgaaagaatatcatctactcaatccggtgattgttgattgtacctccagtcaggcggtggccgaccagtatgccgacttcctgcgcgaagggttccatgtggtgacgccgaacaagaaagcgaacacctcgtcgatggactactaccatcagctacgtttcgccgccgcgcaatcacggcgcaaattcttgtatgacaccaacgtcggcgccggtttgccggtaatcgaaaacctgcaaaacctgctgaatgcgggtgatgaactgcaaaaattttccggcattctttccgggtcgctctcttttattttcggtaaactggaagaggggatgagtctctcacaggcgaccgctctggcgcgcgagatgggctataccgaacccgatccgcgcgacgatctttccggtatggatgtggcgcgtaaactgttgatcctcgcccgcgagacgggccgcgagctggagctttccgatatcgtgattgaaccggtgttgccggacgagtttgacgcctccggcgatgtgaccgcctttatggcgcatctgccgcagcttgacgacgcgtttgccgcccgtgtggcgaaagctcgtgatgaaggtaaggtattgcgctatgtgggcaatatcgaagaggatggcgtgtgccgcgtgaagattgccgaagttgatggtaacgatccgctcttcaaagtgaaaaacggtgaaaacgcgctggcgttctacagccattattatcagcccttgccgttggtgctgcgcggctacggcgcaggcaatgatgtgacggcggcgggcgtgtttgccgatctgttacggaccctctcatggaagttaggagtttaacatggtgaaagtgtatgccccggcttccagcgcgaacatgagcgtcggtttcgacgtgttgggcgcggccgtcacacccgttgacggcacgttgctgggcgatgtggtatccgttgaagcagcggatcatttccgtctgcataacctggggcgatttgccgataaactgccgccggagccgcgtgaaaatattgtttatcagtgctgggaacgtttttgccaggcattggggaaaaccatcccggtggcgatgacgctggaaaaaaatatgccgattggttccgggttagggtccagcgcctgttccgtcgtcgccgcgctggtcgcgatgaatgagcactgcggcaaaccgttaaacgacacgcgtctgttggcgctgatgggcgagctggaaggccgtatctccggcagcatccattacgataacgtcgcgccgtgctttcttggcggtatgcagttgatgattgaagaaaacggcattattagtcagcaggtgccgggctttgatgagtggctatgggtactggcttatccgggcattaaagtttccaccgcagaagcacgggccattttgcctgcgcagtatcgccgtcaggattgcattgcgcatggacggcatctggccggttttattcacgcctgttactcgcggcagccgcagcttgccgccgcgctgatgaaagatgttattgccgaaccataccgcgcgcgtttactgccgggctttagccaggcgcggcaggcggtgtcggagatcggcgcgctggcgagcgggatttccggatcggggccgacgctgtttgcgctatgcgataaaccggagacggcgcagcgcgtcgcggactggctgagcaaacattatctgcaaaatcaggaaggcttcgttcatatttgtcggctggatacggcgggcgcacgagtagtgggataatcaatgaaactctataatctgaaagaccataatgagcaggtcagctttgcgcaggccgtcacgcaagggctgggcaaacagcagggacttttttttccgcacgatctgccggagtttagcctgacggaaattgatgagatgctcaaccaggactttgtcagccgtagcgcaaagatcctctcggcatttattggcgatgaaataccgcagcaaattctggaagagcgcgtccgcgcggcgtttgctttcccggcgccggtagcgcaggtagaaagtgatgtcggctgcctggagctgttccatggtccgacgctggcctttaaagacttcggcgggcgttttatggcgcaaatgctgacgcatatcagcggcgataaaccggtgacgattctgaccgcaacgtcaggcgataccggcgcggcggtggctcacgcgttctatggcctggaaaatgtgcgggtcgtcattctctacccgcgcggtaaaatcagtccgttgcaggaaaaactgttctgtacgctgggcggcaacattgagaccgtggcgatcgacggcgatttcgacgcttgccaggcgctggtgaaacaggcatttgatgacgaagaactgaaaacggcgctggggttgaattcggctaattcgattaatatcagccgcctgctggcgcaaatttgctactactttgaagccgtggcgcaactgccgcagggggcgcgtaaccaactggtgatctccgtacccagcggcaactttggcgatttgacggcaggactgctggcgaagtcgttaggcctaccggtgaaacgctttatcgccgccaccaacattaacgatacggtgccgcgttttctgcatgacgggaagtgggcgccaaaagcgacgcaggcgaccctgtcgaatgcgatggatgtcagccagccgaataactggccgcgtgtggaggagctattccgccgtaaaatctggcgtctgactgagctgggctatgcggcggtggatgacactacgacacaacagacgatgcgcgagctgaaagcgaaaggttatatctcggaacctcatgcggcggtagcgtatcgggcattacgcgaccagttaaaccctggcgagtatggcttgtttctcggaacggcgcatccggcgaagtttaaagaaagcgtggagtccattctgggagaaacgctggcattgcctgaagcgctcgccgaacgcgccgatctgccgttgctttcacatcatctgcctgcggattttgccgccctgcgtaagctaatgatgacccgccagtaaccattgcgcccggtggcgctgtcgcttaccgggcctatggggtggtgccgatttgtaggccggataaggcgtaaccgccatccggcgatgtcgttactgctcgtagcgtttaaagaccagctcgtcttgtgtggaggtttcttcatcaaagaaatacccttcacggtcaaacgcggtaagctgttccggcttcgttaagcggttttcaataataaaacgactcatcagtccgcgcgcttttttggcgtagaagcttaccaccttaaacttgccgtttttctcatcaaggaatacgggcttaatcagttcggcatccagtttcttcggcttcaccgatttaaaatattcctcggaggccagattcaccaccacccgatcgccctgcgcctcaagcgcttcgttgagcttatcggtaatgatatcgccccagaattgataaagatctttgccgcgcggattctccaggcgaatccccatctccagacgataaggctgcattaaatccagcgggcgcaatacgccatacaagccagagagcatacgcagatgttgttgagcaaaatcaaaatccgcgtcgttgaacgtttccgcctgtaggccggtataaacatcgcctttgaacgccagaatcgcctggcgtgcattatccggcgtaaaatgaggctgccagtcatgaaaacgcgtggcgttgagatccgccagtttgtcgctaattcccattagcctggaaatttgcggcgccgaaagctggcgggcctgttgaataagctgctggctgtgatccaacagctccggctgggtatagcgggtcgtggccagcgggctttgataatcaagcgtttttgcaggtgaaatcagaatcagcatatccagtccttgcagggaattttctgcgactttagcaaaaaaacgccgcagagttgaccgatggttgcgattgtcggcttaatcgcgcgatgccgcatcccaggtatctggcgccagttgtggttcgatatccgggaagcgccgcggatcgaactgcggtcttacgcccagtttccgttgtcgcagataatcgccggcgagggtatacaccaccggtgagagcaacaaaatcgccgtcagattggtaatggccatacaggccatgatcatgtcagcgagctgccatatcagcggaaaactgataagcgtaccggcgatgaccatgccaagcgtcgcaagacgtaatagccagatggcctttgcgttatgtaaccgcagaaaaaagagattgttttcggcgtaaatatagttggcgacgatagaactgaacgcgaacagaatgacgataagcgcgacaaaactggcgccccattcaccggtcaacgaaaccattgcatgttggagaagctgaatgccttctgttgacgaatgggacgcgtgattccccgccagcaggataatcatcgcgctggcggtacagatgataatggtgtcgctgaatacgccaatcatttgcacaatcccctgcgcgacagggtgagggggatacgacgttgccgctgcggccgcattaggcgttgaccccattcccgcttcattagagaacatcccacgctgaaaaccgctggtaatagcctgggtgagcgtatatccggctgcgcctgccgcggcttcctgccagccaaatgcgcttttgactatcgaggcgataacgccaggcatttgctcaatatgccagaggcaaatgaatacgctgccagcgacccacaataacgcgatgaggggaatcagccattgcatcaggcgggcgacgccttttatgccgcggatgataattaacagggcacagaacgccaaagcaatgccggagataagcggcggaatgttgaaggcgaaatggagcgcgcgtgagacggcattcgcctgcacgctattaaaaatcaacccgtaggcgacgagcagaaagagggcgaaaaccacgcccatccagcgcattcccagcccgcgcgccatataccacgccgggccgccgcggaactggcctgtcgggtcacgttctttataaagctgggcaagcgaacactcggcgaaggaggtcgccataccaatgatggccgagacccacatccagaatactgcgccgggaccgcctgcggcgatagccagcgccacgccggccagattaccgctgccaatccgcgccgcgaggctggtacacagcgcctgaaatgacgtcaggccgcctggctgcgggctaaggctgcctttcagactgcggctaaattggcgaatataacgaaactgaatgaatccggtacgccaggtaaaccaacatcctgcgccgagcagcaggtaaatcattaccgagccccagagtatttcgttaataaaactgaaaaactcaggcattaacgtccctcttgttgatgccgacacgctttgatgatcctgtataagcgtgacccatgatgtagatgaccttgtcaggctaatattaacggtagtttaccataaatacggcggtatcctttaattgcgcatcaaccgtcggcagatacgcaaacagttcacaagggcagccaggtgcatgtaggcggttgcgctgtgagtgcgtcgtgttatcatcagggtagaccggttacatcccctaacaagctgtttaaagagaaactctatcatgacggacaaattgacctcccttcgtcagttcaccaccgtagtggctgataccggagatatcgcggcaatgaagctgtaccagccgcaggatgctacaactaacccttctctcattcttaacgcagcgcaaatcccggaatatcgtaagctgattgacgatgctgtcgcctgggcgaaacagcagagcagcgaccgcgcgcagcaggttgttgacgcgaccgataagctggcggtgaatattggcctggaaatcctgaagctggtgccggggcgtatttctaccgaagttgacgcgcgtctatcttatgacactgaagcgtctatcgccaaagcaaaacgtatcattaaactctacaatgatgcgggtatcagcaacgatcgtatcctgatcaagctggcgtccacctggcagggcattcgcgcagccgaacagctggaaaaagaaggcatcaactgtaacctgacgctgctgttctccttcgcgcaggcgcgtgcgtgcgccgaagcgggcgtctacctgatctcgccgttcgtaggtcgtattcttgactggtataaagccaataccgacaagaaagactatgcgccagctgaagatccgggcgtggtttccgtaacggaaatctacgagtactacaaacagcatggttacgaaaccgtcgttatgggcgcaagcttccgtaacgtaggcgaaattctggagctggcgggctgcgaccgtctgactatcgcgccggcattgctgaaagaactggcggaaagcgaaggggcgattgagcgtaagctctctttctccggcgaagtcaaagcgcgtccggaacgtattaccgaagccgagttcctgtggcagcatcaccaggaccctatggcggttgacaaactggcggatggtatccgtaagtttgcggtagaccaggaaaaactggaaaaaatgatcggcgatctgctgtaatcattaacgcgtggccctgatatgggtcacgctacctcttctgaaacctgtctgtccttcctttcgcagtgtatcattctgtttaacgagactgtttaaacggaataatcatgaatactttacgcattggcctggtttccatttctgaccgtgcttccagcggcgtttaccaggataaaggtatcccggcccttgaagagtggctggcatctgcccttaccaccccttttgagctgcaaacgcgactgatcccggatgaacaggcgatcatcgaacagaccttatgtgaactggttgatgagatgagctgtcatctggtgctgaccactggcggtaccggtccggcacgtcgcgacgtcacgccggacgcgacccttgccatcgccgaccgtgaaatgcctggttttggcgaacagatgcgccagatcagcctgcgctttgtgccgaccgccattctttcccgccaggtgggcgttatccgtaaacaggcgttaattcttaatctgcctggacagccaaaatcgatcaaagaaacgctggaaggcgtaaaagcggacgatggcagcgttagcgtgccgggcatttttgcgagcgtgccgtattgcatacagctgcttgacgggccgtatgtcgaaaccgcgccggaagtggttgccgctttccgtccaaagagcgccagacgtgagaatatgtcgtcctgaccgggagatactgatagtagggttattcctcccggtgcgggaggaataaaagagatttagtgcgcctcgccgattggcaaaatagtgcggccaaattgctcgtttagcacttcacccatcgccagataaatagcgctggcgccgcaaaccagaccaacccagcctgcgatatggatagttgcttcgttaccggtgatattgccgaccgccagcagagcgaacagtacggtcaggctcaggaaaacaaattgcagcgcgcgggcggctttcagcgtaccgaagaacataaacagcgtgaacacgccccacagacctaaataagcgccgagtagctgagcgtcaggcgcatccgtcaggcccattttcggcatcagcaggatagcgaccagcgtcagccagaacgaaccgtaagaagtaaaggccgttaaaccaaaggtattgccttttttatactccagcagaccggcaaaaatttgcgcgataccgccgtagaaaatccccatcgccagaataataccgtccagggcgaaaaaaccggcattgtgcaggttaagcagaatggtggtcatgccgaagcccatcaggcccagcggtgccggattagccaacttagtgttgcccataattcctcaaaatcatcataattgaatggtgaaatagtttcccagaataacgagttccgtattcggggcgcggcataataatcagggggaagaggactgtctatgatctaataagggggaaaagaaaatatttccccctgtgagggcattcacgcctgaacggctgccatcattcgtcgcaggcaggctatttgcaagaccgccggaatagtcacgcgatacgcgctgccgctcatcgctttgacgccgtttaatgccgcgccgaccgggccgccaagacctgcgccgcgcagcaatccgtggcccaggatgctcattgcggcatgggtacgtaaaatgcgggtaagctgggtggaaagcaggtgggagaccccttttgccagactgcgatctttcatgagcagcggcagcagttcttccagttcagaaactttggcgtctacggcttgcagaaattcctgcttatgcgccgcgtccatcttctgccaggtatgacgtaaaaaatgctccagcagttgctgttctatttcaaacgtcgacatgcttttatctgctttaagttttagccgttttgcgacatccagcagaatcgcgcggtactgttttccgtgtccgcgcaatttgttggcgatactgtcgccgccgtaatgctgaaactcgccggcaatgagctgccagttacggcggtgttgctccgggtgaccttccatcgctttgaacagctcgttatgactaaggacgctcgacaagcgagctttgcccttttcgttatgcgtcagcaaacgggcgaaatcggcgagttgttcttcgctacaatgctgaagaaagtctaaatcctcgtcgtgtaaataggtgacgttcattttcagtctggcttttggaatagaaataacagcgattaatcgtcgccaatgactttaagtctcgccatatcggaagaatttaccgtatgacctgagaaggtaatctttgatacgcagcgtttgttgtcgttatcgctattaatattgatccagcctgtcgtctggccttctttgattgaggaagggacgttcaggctttggctggcgctacgcgcagttttaaaatagacggatgcgccgctaagttcgatatcgccgtgatccgccgtgagttgaatgcgcttcacgatgcggcagacgggaattttcagcgcgagatcgttcgtttcatttctgggcatggcaataacacccagtattttatggtcgttcgcgtgcgcgacgctacttaacgccaggccgaaaagcaggccgacggaaatcgttaacacagatcgcatgaaatttctctttgacgggttcaataagcaattaccgtctatcatactctgctcatgacaacgattcagttttgtaatcttttctttttattacaatttttccgtgaatggtattcgttgtttaatttattttatgaatgtttacctgtctggttttccatcgcgccctctcgtcaataaaaaattttttcatctcccccttgatgacgtgggttacgaccccatcttgtagtcaaccgcagtggtgagtctgaaaaaaaacgattcagggtagttgaaaccgcacgtttcgcccttattacagattcacaaccacatgatgaccgaatttttagtggagacgtttagatgggtaaaattattggtatcgacctgggtactaccaactcttgtgtagcgattatggatggaacgcaggcacgcgtgctggagaacgccgagggcgatcgcactacgccttctatcattgcttatacccaggatggtgaaactctggttggtcagccggctaaacgtcaggcagtgacaaacccgcaaaacaccctgtttgcgattaaacgcctgattggccgccgcttccaggacgaagaagttcaacgtgacgtttctatcatgccgtacaaaatcatcggcgccgacaacggcgacgcatggcttgatgtgaaaggtcagaaaatggcgccgccgcagatttctgccgaagtgctgaagaaaatgaagaaaacggctgaagattatctgggcgaaccggtaactgaagcggttatcaccgtaccggcttactttaacgatgcgcagcgtcaggctaccaaagatgctggtcgtatcgcggggctggaagttaaacgtatcatcaacgaaccgactgccgcagcgctggcttacggtctggataaagaagtcggcaaccgtactatcgcggtttacgacctcggtggtggtactttcgatatctctattatcgaaatcgacgaagttgatggcgaaaaaacctttgaagttctggcaaccaacggtgatacccacctgggtggtgaagacttcgatacccgcctgatcaactacctcgttgacgagtttaagaaagatcagggcatcgacctgcgtaacgatccgctggccatgcagcgcctgaaagaagccgcagaaaaagccaaaatcgagctgtcttctgcgcagcagaccgacgtgaacctgccgtacattaccgcagatgccaccggtccgaaacacatgaacatcaaagtgacccgtgcgaaactggaaagcctggttgaagatctggtgaaccgttctatcgagccgctgaaagtcgcactgcaggacgctggcctgtccgtgtctgatatcaacgacgtgatcctcgtcggcggtcagacccgtatgccaatggtgcagaaaaaagtggctgagttcttcggtaaagagccgcgtaaagacgttaacccggacgaagctgtggctatcggcgcagcggtacagggcggcgtattgaccggtgatgtgaaagacgtactgctgctggacgttaccccgctgtctctgggtatcgaaacgatgggtggcgtgatgactccgcttatcaccaaaaacaccaccatcccgaccaagcacagccaggtgttctctactgcggaagacaaccagtctgcggtaaccatccatgtgctgcagggtgagcgtaaacgtgcgtctgataacaaatctctgggtcagttcaacctggatggcatcaacccggcgccgcgcggtatgccgcagatcgaagtcaccttcgatatcgatgctgacggtatcctgcacgtctccgcgaaagataaaaatagcggtaaagagcagaagatcactatcaaggcgtcttctggtctgaacgaggaagaaattcagaaaatggttcgcgatgcagaagcgaacgctgaatccgaccgtaagttcgaagagctggttcagacccgtaaccagggtgaccatctgctgcacagcacccgtaagcaggttgaagaagcaggcgataaactgccggctgatgacaaaaccgctatcgagtctgcgctgagcgcgctggaaactgccctgaaaggcgaagataaagccgctatcgaagcgaaaatgcaggagctggcgcaggtttcccagaaactgatggaaatcgctcagcagcaacatgcgcagcagcaggctggctccgccgacgcttctgcaaacaatgcgaaagatgacgacgttgtcgacgctgagtttgaagaagtaaaagataaaaaataatcgccctttgaacgggtaattactggcacgggcgaagaggtttcctctccgcccgtgtatgcatgttaagggcagataaaaagagatggcgaaaagagattactacgagattttaggcgtttccaaaacagcggaagagcgtgaaatcaaaaaggcgtataagcgcctggccatgaaatatcatccggaccgcaatcagggtgataaagaggccgaagctaagtttaaagagattaaagaagcctacgaagtgctgaccgatgcgcaaaaacgcgcagcctacgatcagtatggtcacgccgcgtttgaacaaggcgggatgggcggcggatttggcggcggctttaatggcggcgctgatttcagtgatatctttggtgacgtttttggcgatatctttggcggcgggcgtggtcgccaacgtgcggcgcgtggggctgatttgcgttataacatggatctcaccctggaagaagcggtgcgtggcgtgaccaaagagatccgtattccgacgctggaggagtgcgacgtttgccacggcagcggcgcgaaagctggtacgcaaccgcaaacctgtccgacctgtcatggttctggtcaggtacagatgcgccagggattctttgctgtacagcagacctgcccacactgtcagggccgcggtacgctgatcaaagatccgtgccataaatgtcacggtcatgggcgtgttgaaaagagtaaaactctgtccgttaaaatcccggcgggcgtggataccggcgatcgtattcgtctggcaggcgagggcgaagcgggcgagcatggcgcaccggcaggcgacttgtacgttcaggtccaggtgaaacaacaccctattttcgagcgtgaaggcaataatctttattgcgaagtgccgatcaactttgcgatggcggcgctcggcggtgaaattgaagtgccgacgttagatggtcgcgtgatgctgaaagtaccgagcgaaacacaaacgggcaagctgttccgtatgcgcggcaaaggcgtgaagtccgtacgcggtggcgcgcagggcgatttgctgtgccgtgtggtagttgaaacgccggtcggtctgagcgaaaaacagaagcaattgctaaaagatcttcaggaaagttttggcggcccgacgggagagaaaaacagcccgcgttcaaaaagcttctttgacggcgtgaaaaaattctttgacgatttgactcgctaacctttttcccgttgtatttttcttcagcccgggtgtatgtatatccgggctttttttctgcctgtacgcgcccaggcttctgctaaacgcatcgtatcctctcatttgttggtattttgttttactgataaacaaattgatgttaatcagcaggtttgcatacgctcattttaaaaaaaaatgtaatgtgatgacattaacgattgcttttttagacgctgtgaattgatttatcttgagtattatctatattgctttttttagtttccggaggcagacagcgaatgggatcgaaaggtgccaacaagagctttgattataatttaatcaaaattcttgacgctgttattttgtcaggaaatgcggctatggcggcaaaaaagttaggcattacaccggctgccgtttctctggcgttaaagcgcctgcagagttattacccggaagaactgtttagcagagggaaaggcgggctcatccccactgctaaggctgtcgacattcaccaaaatttcagtcaggtgatgaaactggtggatgacacatttctctgtaatagcaaaaaagatgaagcgttccagataacgttattaggcagtgatattgttgaaagctattatctttctcagctctataacagcgatatatttgaccgtattttgataaatcatttctccgtcagaaatatgagtcgggagcatatcagcgaacttctgtttactgcgcaaggcgatctgttgattagtgccgaacctttgctggagtccggcatagagaatcaaatcattgatagttttaaatcatttgtttgtatctgtagcagtaaacacatgctgagtaccctctcgcaactgtcgctacatcatttttattcttcgcgtcatgcgttatatcagccggggatgggggcttcagtgatatatcatgatagcgagttatttaaggatgagctttactatactggcaggcgtattgtcggctatcgtagtgattcacttaacggtttgatgagcatgatcgaacgaacctcattgattgcattgatgcctttgaaattagcgcttttttataaaaatcatcgtaaatatgacattaaatttattcagcctccgcccgaactggcctttaagtcagttcaggtctatgcatcctggaagaaaaatagtagaaatatatcgacgattaatgagatggtaagtatgttgcaaacactttcctccttccgtcgctaacacacctcatttttacgctttgatttaatatggttttaaatgatgtgctttgatttttacccttctgacagggcgcttacactccttgtgttaattattcatttataatgatttcggggtgttaaaatgtctattcccaaccatgtgtcgacaacggaagttgtgctattggagctagagatcttactcactattatttcgattggcgcgtggggaggctttgttagctatcttttacgcaaagataagacagaatataatagttctcatgaaagtattaaatattgcttaacgcagatcgtgatttcctgcttcaccagctttttgttaagcgcgattgcgatcgaaaaagaatgcagtttcaatattgtcctgttggcggcaggcttaggcggtgttttcgcgagtccgatcttaaaaattcttgggcggcgaattaaaaaaattatcggaggaaataattcagattaattgtcattcgcaatatcaggctcatccgtgagccttttacgcgtcttttttcagcctggtctaggtcactctgttcttgatccagccataaataaattgttcgttattgtggtttttctcagcaacgtttaagtagtacatgccctgactgcaattgagggctttcaccaaaacggcttccccttcctggcctcgccaggccaaataatgttcgagagcggcaagcgtccgcgggccaatattgccatccacatgaacatccgggtagcgtttaccttcgtgattaaagacgttcagccagcgttgcagccacgcgctggggtggtaatcgcctatgttgactgccgcatcgcacagctcgaatgagactggccacgatagcgtcgagatgacatcaaagcctggttttatccagtaatcctcttcgagaatcgcgtaggcttcagcgtgggtcagatcccgcatatcgccagcatagccatgcgctcgcgccgtggcttcggtaatgccccaatgagtggcgccgcctttatctttagggttaaatacgtaaccgccttcaagcgcaataattccatctataattggattcatcttccctttccttcgcttagtgaatatgcagatacatgagagaacctaacgttactgaaaatacggtcgtcagggcagcgatggtttgccgtacaatctgtttttttcttccctttgtttcgctatccgtcgcgataatggcgatatcactattcactttgagaccttgtcttggaatggtaataaaaagatcattaataccaagcgctttaaggtcacgtctgattaaatagagaatctgcgttagatttgcatcattaacatagtggcttcgacttccccataacgcagtggttattttttgtcgctcgataatctccagatgagcattctcgatgatgaaactgagacatttggctctcatcgcagtcattttaataacctgtgaatttgagaccgtcctcagttcatatttaccttcattgtaaatgcaattgctattaatgatataagttttcataacgtcttcctttagaaatgtacatcctggttgtctgtggtgactatattgtatgagaaatgtcttaatccaataaatgtcactggttttattgtattgtcattgtctatagcgagtgtaatcacattatttcattgtaattaaatgatatttaattacatgataaatgatatttactatgttctcaccagaacggagtaagcgggcgctgagaggtgttgttttctcttcgtcagacggtgttgttaacctcatttttatgatttttatatcatctaaaaaggtgatgttttgtgattagctattttttatgcctgtagcgattatggaccccgcagaacgagctgcgacaattttgaaacgtaaaaggaaatttgaaaatggctacaagcaaactgattcaaggcgatacgattactgaaactacccatgcagcgaatggttttgaccctgcaacaagcgatgataaaataagctatacttccgctcgtgttgcgaaaccggtatacaataaatataaaaattccacgactaagccgaaggtattcggttattacaccgactggtcacagtatgacagccgtctgcaaggcaatatgtcccaaccgggccgtggttgtgatttaaccaatgtttcaccgacggcttatgacaaactgatttttggttttgttggtatcaccggtttcagaaaaattgataaagaagaccgcgacgtcgtagcagaagcggcagcgctgtgcggcaaagtgaaatatgagccgaccttcctcgatccgtggggcgatttccagtcttatatcaacctgggttttgaaaccagcggctgggatgttgatccgaaaaccgtgacccaggctaacgctaaaggtatgctgggcgcgctgcgtgatatgcaggcaaaagcgaaagctgcaggtcacacgctggcgctctccatgagtatcggcggctggagcatgagtaacgggttccacgaaaccgccgcttctgactcttctcgtaaaaccttcgccaaaggcgtggtgaaactgttcaaacagttcccgatgttcagcgaagtggatattgactgggaatacccgaacgatgaaggggcgggcaacccgtttggcgcagaagatggcgctaactacgcgctgctgattgccgaactgcgtaaacagctggattccgcgggtctgagcaatgtgaagatctctatcgcggcctccgcggtgaccacgatttttgatcacgctaaagtaaaagatctgttggctgctggcctatacggcatcaacctgatgacctatgacttcttcggtacgccgtgggcggaaacgctgggccaccacactaaccgcaaagcgctggaagagggcggctgggctgtcgaaaccatcgttgatcacctgctggcggaaggtttctccgctgaccgtatcaacatcggttatgccggctatacccgtaacgctcgtcaggtagaaattgaatccctgtcgccgctgaaaggttcttacaacccaggttcaggcgatactaccggttccttcgaatccggcaccagcgaatggtatgacgtcatttatagctacctggatctggaaaaccagaaaggccgtaacggtttcaacgtttacaccgaccaggtcgctgacgctgactacctgtatagcccggaatccaaactgtttttatccctggatacgccgcgtactgtcaaagcaaaaggcgaatatgcagcgaaactgggcctgggcggcgtgtttacctggactatcgatcaggacaacggcgtgctggttaacgccgtgcgtgaaggtctgggttatgaaatcgaatctgaagttatcgatatggaaccgttctacttcgaaggtatcaatgtagaaaaagatgacgagcagagcgatagcgacgacgcgcagaaggtcaaccacgcgccgaaagcggcgattgaactgatggtcgtaggcggatcgacggtacagctgtctggcgcaggttcttctgatgaagataacgatgagctgtcctttagctggggcgtgccttctcaaatcgatgtggcagacaaaacggcagaaatcattgaggttgtggtaccggaagttagcgaaaaaacagcctttcagttcaccctgtttgtacgcgactgctacaacgaaccgtcctctcaacagcgctttgttctgacggcggtgcctgcgctatctcaggttcaaccggaaccggaagaggaagaagagattatcgttcctgtaccggacgaggaagaagagaccacgccggctgaggatgatacgtcagcagatgacaaaacgtcaccttacgcgcagtgggatgcttctaccgtttatggcgcaaactggggttctttcgaaatcgttagctggaaaggccataactatcaggtgaaatggtggtctatgggcaaccagcctgacctgaactgtggtgtcggcggtgcatggaccgatcttggcgcttactaatacacggtattaagccgatgtattgggcttcatgattcaagccccggtttaccggggcttttctccaccagggacagaggaagagcagaccatgaccatttccatccatgccagcgcatttgacgtcaacagctggtatcaaaaaatcaccttaaccttcatcaatgagagcggtaatccggtcgatatgaaccatgccgcaatatcattcacggcttccgggcacatcgatccatggggaaatagcggcggtacgctcaaagggaacccgccgcttacgctgaatgatagttcgtatggcacgctggaaactaacaacatcatcattaataacagcgatgcattacttcttcagccgggcgaacgcggaacgctctctttcagcctcgcggcgacgcaggtgccggtaaaaatgtccgccgtcaccttgacgctggcgtcatcgtcatccgaagacgcagagtctgcaaccccatccgatcaggagacgccagcgatacccgccgcagacgaacaacccgccgaatccgatgtgccggaaaaggacaatgaccttcaggaacgcggccttacgcttaacgttagcgagttgaatgccgcaagttggtatcaacacgtcacctttacgctgaccaacctctacgcccaggcggtagatctcaatcagcttcaactgaattttacggccagcgcgcaccccgatccctacagtccgtttcagggaacaatgctggggaatcaggccgtgacgctggccagcgatgggggatggcccatcgagaagaataccatcaccattaatcatgacggcgcgctgatgctggcggcaggggatatcgccgaattacagtgctatctggccgccacgcagacgccagttgccatcagcgatttgaacgcgacgttggcccatgaccctgcccaccagggaaaaatttgcgttcactttcctgccatgacgcagaccgtggcgctcaaaccggtgattgagctactgtttcctgccggcgaaacccggcgctttgtcggtgagtggggagaggttctgacaataagcgatcttagcgcaggaacgtatcggcttatcgtaccggtactggcgaatgatgagatgcaaatcgcgccagtcgagtcctcttttaccgttacgctgcaatccggagatgccgccgcgcaggtctaggtatcttgtttaccgattgtccattatgccagcgcgcgtctgatgattgatgcccctgcgcttggtaatgcgaaattgaccgttgaaatcgccgatgctacgcaagcggatgagcgtaccgtcacgcttatcgccaaccaaccgcagttaatcacccggctactggcggggcatcattatacggtcaatctgcagcctgcgatgattaataaccgctttatatcggcacccatacagcttacgggttttatccctgctgcggcgcaggttgccgaggttgctgtcgcttaccaacagtcggcgctcgacacggcgagcttcgtgacggtagatgccactatactgggcctgcccgatggcgtcgcgccgcagcgttatctgttcagcagcggtaaatatcaatactcattaatgctggagagcggcagcgatcggcagacgctgtcattacgctttgcgcccgggctgtatgatgttcagacggacgatattttcatcgacagtgtgccgtggcgttgtgaacaggccgggccgctacgcttgttgcaaaaggtcaaccatgtggcgctggagtttctgcccggcgtgacgctacaggtaaaaggttggcctgattaccttgctcatggcggcgtgacggttaacgcgccagagacggtttctctttatcgcgatataccgtttagcgcgttgtttaaatacgacggttttgacggcggcggcgatccggtgccggccgcagaggttgacgtgaacggggatgtttttctggattacgcgacattaccgatccataaaaccgttgcgctggtgcgccagatcgaaaaagaagccgggcgtagcgtcatgccggtaatggtcatttataccgcgaatgccagcggcggcagcgcgctggtggatttacaggatgcgcaaaagctacgtaaccattttggtaactttattacccagtgtctggcggcgcagtcatacaaagatgagacgcatcctgtcccggccacctttgtgcttaacccggattttctgggtgcgctacagcaaggaccgtatggctataccgtagtacggcaaaaaaacagtgtgccggtgaatgcccaactggcggcggcgatacaagcattaccggcgatggctggctttatcgcgccttcgttgccgacgtttagcgacgatctctacggttatattcaggcggtgaactatcttgttcgtcagtttgccccggatgtggcttttggctggcagacgaatgtctgggcgacaggaacggcggactgggtgctgcgcgataccgctgatccggtagctgaagggcaggcgatcgccggatttattcatgaactgggcgtttatagcggagaatatgcgccggactttattgcgtttgatgaatttgagcgtgactgtttcagtcctgatgcgcttgcccactatggctggaatgcgacatgctggcttaattacctggcgatggtaaaacaggtgacgaaagcgctgctgacgcccgccatgctgtggcaaattcctggcggccatatgcctacagtagaagagggcgtcagcaaaatcagcgctgcgcactttgcatccggcggaaccttttttatgggtgacgcccgcattggcagcgatcctgacacgctctctttgcagctactcaatacggccttaaatagcgcgacttacggcgtcccgaccgtcggcgactttttacgtaaagataaagggtatgactggggccagatgcaggcgctgaacctaccggactttaacgtcttttcgatcttatggggcggtggttctactatcagtattacgacaatccattctaacggtgaagacggcggctggctggcggataaaatggtagagtattatgctgctccacgctattttagataatatcactgcttatttgcattaatctggcctattagtttgagattcgaaggcgcgttctttcgaatctcttttcctgcgccccctgacctctcattctttatgcgtaattcgttattaattttctgtaatcaatttgtattaagaatcgtcttaatcttaaaaatattgcgtattagtgcgttgtgaatacagaaatactgcatagcgatgttatttattattaatttaagtactttttgagaggttatactgtggcgctacattgagtagacaaccgttaatgaaaaaaatgatgaacgacgcttttgctaaagataataatgagaatttattacactcttttcttttttctcagcaggctaaacctcacgcggcgattgatgccttattttcggccttgttgccatttggtcaaccgtttacgctgggtatcggcgatgagttttatttacaggccaatgatgaacactacattgtattactggagtcaggaattgtttctttctgtcgtgatgacaaccgactccatatatcttcatcgtttgcgccatcggtcgtgggtatggttgacagctatggcgctacctataacgttcccgcgcgcccggaacactttttgctcgcagaaacggtttgtagcggtagatttgttcgcctgccggattttataaaaatcgccgatgaatgcgatttgtggcacgacgtggcccgttgtctggcttaccgtctgatggtgatgagcgcgcgcgatcgtgaattagtcggcgtcgattcttacctgaaagttcgggcgctgctgattgaaatctgggcttatccacaggcctaccgggaaaacattatcgtattgaattttattcaacggcgtaccgggatatcgcgcagtcggactatgaagattctgtctgaactaaaaaaaggcgggtatatccatattgataatgggcggctgacggcactcggaaaactgccagtggcgtattaatgcactatacgcaacgatatatttacatatctcaactgaatttgcctgttatcgttaataaaatgttttattgaaaattgttaagaagattatttttaaaaagtcaatatgactaaaggagataggccgaacggctggtgtaaagtcaatataaaacaacatgttacatctagtcctttaaaaccaaatgtcgatgattgcaacttgccgttggcttgctaataattaataacatcgttatctcattataacgtaaagattaactcacgacgttgagtagctgttttattgcctctgacatttatatcagaacaagaagacacttttttcgcataagaaaagtcgtgatattgctgtgaagaaatatcagcagccgtttcgttaaaaaatctgattaccctcatttttatatttaaaaggagcttgaatgaaaaagcctgtactagcattaatggtctctgccattgcctttggcggaatgttgtccaccgcgcaagcggatactacaaccgtcactggcggtacggtaaattttgtcggacaggtcgttgacgccgcctgttctgtttccgctgactctgtcgatcagaccgtgacattaggccaggttcgcgccagtaaattaaccgaggccggtatggcggcgaatcaaaaagaagatttcaccattaaactggaagactgcgatactcagaccagccagaatgcggcggtgatttttaatggccagcaggacgcaaaccagccgggttcgctggcgaataccgctggggcaggttcggcgacgaatgtggcactacaactttatggaccggatggccaggcgctgaatattggtgaatcgtccagtactgttaccttgaacgatggcgaaaacgttattccgcttagcgtggattatatcgctaccggtacggcgactgccggtaatgttaccgcgacggcgacatttagcatggtttattcctgattccttatcgggatttttttctcgtctgttgggaggcgagaaaggggcgttacgcgcgtcactgcgcgtaacaaaccgacggcatcaggatattacgcagatgaaaaaaaacgtaccgattttccttcgattattgctactgctgtcggcggccggcctgtcgtttgccgtgcaggcgggaggcattgcgctgggcgcgaccagggtgatttatccgcagggaagtaagcaaacctccttgccgattattaattcttctgccagcaatgtttttttaattcagtcgtgggtcgccaatgccgatggttcacgctcgacggattttatcattacgccgcctctctttgtgatccagcctaaaaaagaaaatatattacgtattatgtatgtcgggccgtcattaccgaccgatcgcgaaagcgtgttttatttaaacagtaaagtgataccctctgtcgataaaaataaactgaccggcaactccctgcaaattgcgacgcaaagcgtgattaagctatttatccgcccgaaaaatctggcggaggcgccagcccatgccccggcaacgcttcgctgccgtaacgagcgcggccagctaacgattactaacccttcgccgtactacgtttcgatggttgaactgtacagcgcggggaaaaaactgccgaatactatggtaccgccgaaaggcgcgatcactctcccggcgacgcctggccaggtatctttgcgcacggtaaacgattttggcgcaacgacgccagcacgcgtttgtccagcttcatgatgttatgcgtaatcagcttttcatgacgcgatattactccagcgtagctaaacccgtattaactccgctggcgttggctatcgcactggcgcctgcgcctgggtgggcggaaaactatttcaacccggcatttctgtctgacgacccgtctgcggtggccgacttatcgaccttttcccgtaatgcccaggcggcgggaatgtatcgcgttgacgtttacctgaacaatacgtttctcgcgaccagagacattgccttccaggcggtgaagacgacgggaaaaagcgcgcccaccgatgacagcggattacgcgcctgcctgacgcctgaaatgcttaaaaatatgggggtaaacaccggggcatttccactgttggcgaaggcggcggcgggaagttgtccggatctcgccagtgcgataccggccgcccggacccgctttgattttgcgcagcaacgtctcgacattagcatcccgcaggcggcgatggttgccagcgccagaggctatatcccaccgcaatactgggatgaaggtattaacgcgttgctattgaattacacctttaccggcgcgaatagtcaggatcggagcccaggcggcagtgcggagaacagctattttcttggattgaatagcggccttaatctgggggcctggcggttacgcgactactccacatggaacgcgaatagcggcgatcagaatagcgacagcgactggcagcacatcagtacttatctggaacgtgatgtggtctttttgcagggagaactgacggcaggcgatagttataccccctccgcattattcgatagccttccttttcgcgggctacaactggcgtctgacgacaatatgttgccagacagcatgaagggcttcgcgccgaccattcacggcattgccagaagcaacgtgtaagtgaccattcggcaaaacggctacatcatcaatcagcgctatgtgccgcccggggcatttactattaatgatctctatcctaccgccgccagcggcgatttgactgtggaagtcaaagagtccgacggttctattaatcgctataacgtgccctattccgccgtgccgattctacaacgagaagggcggctgaagtatgcggcgacggtggcggagtatcgtagcgatagtagtcaaaaagagaaggtgaaattcagtcaggcgaccttgatatgggggttaccgcatggttttacgctgtatggcggaacacaactttccagtcattatcacgcgctggcgatcggcagcggcgcaaatctgggcgactggggcgcggtgtcgctggatgtcacccaggctaccagtacgctggcggataataactcctaccaggggcaatcgctgcgtttcctgtatgccaaatcgcttgcacagtcaggaaccaatttacagcttatgggctatcgctattcaacctcgggcttttacacgttggatgataccacgtggaaacggatgagcggctatgacgatgacaatcggactgacagcgataaaagcaggccggaatgggcggattattacaatctttattataccaggaggggcaaagtacaactcgatatcaatcaacagctaggcgggttgggatcgctttttattaccggcagtcagcaaagttactggcacactgatgaaaaggattctttgttgcaggtgggatacagcgatacgctggcgggtattgcatggagcgtttcttacaacaataacaaatccgcaggcgatgcggagcgcgatcaaattttcgccctgaatatctcggtgccgctaagtcaatggctgcaacatgatgatgaggtcacgcaccatcacaatgtttacgctacctttagcaccagtacggacaaacagcataacgttacgcagaatgcgggccttagcggcacactactggacgaaaacaatcttagttacaacatacagtaaggctatcagaatcacggtattggcgaaagcggcgccgccagcctggaatacgatggggcgaaaggcaacgccaatattggctataacgttagcgataacggcgattaccagcaggtgaattatggcctgagcggcggcctggtggcgcacgcgcatggagtgacgctaagccagccgttaggcaataccaatattttgattgccgcgccgggcgcagccaatgtcggcgttgtcgaccagccgggtattcatacggacgcgcgtggctatgcggtggtgccgtatgcgacgacatatcgccaaaaccgtatggcgctggacgttaacgccatggctgatgatgtcgatattgatgacgcggtgactcgcgttgtgccgaccgaaggcgcgctggttctggcccgctttaaagcgcgagtcggcgtgcgtgccctggtaacgctgaatcataatggtaagcctgtaccctttggcgcaacggtgacggtgaatgatcgccatgcggaggcgattgttgacgaggccggggaggtctatctttccgggttgtcagcgcaaggcgttctgcacgttcgctgggggaacctgccggatcaacagtgcgtcgcgtcctatcatctctcttcctcccgtcagattctgagtcgacaatatgcggagtgtcattaaatgaaaatacctcttttatttgctctgctggcggggagtgtcgtatcgcagtacgcacacgcagacgtgtgtaaaaacgttaacggcgtgccttccagtattaattacgatttaacgaccactctgacggcagaacaaaaccaggtgggaaagacggttcaactggaaaaaagccaggaagttaatgtacaggcggtgtgtcccgccggcgcgtcgacctatagccagacttatcgctcctatgtgtcgccatatccggtcgtagaaacgagcggtaactggaaatatttaaagctgggcccggactaccttgaaggcggaatgcgaattgaggattcttcggcgggcgatatctatccgccaatgaacaatgtcctgatgggatatgatgaaaatgtgaaagcgggtcaaccgttttacgttcgtgactcaaatctggagtttcagctcaaaattgttaaaccgttcgtcggcacggtgaatattagtcctaagactatgttcaatgtttatgtcatgaccgccgcaggcgatccgctgacagatgtcgtgtacagcattctttatagtggaacggtgaccgtaccgcaaagctgcgaaatcaacgccggacaaacgattctggtgaatttcggtgcattatacagcggcaatttcaaccatgcaggccaaaagccggagggggtacgagcgaaaaaattcagcgtaccggtaaagtgcagcggtctggattcgcaggtcaatttaacgatgcgtcttatcgctacgccggatagccactttccccaggctatcgcttcggataatgccgatgtcggtgtagtggtcgaaaccgatgaaggaaacgcgcttattcccaatgatgtacagagcgtcgcgccttttatcaccgatagcgccggacgcgctaacatcacattgcaagcctacccggtgagtacaacaggtgaaacgccagcggaaggggcgtttaccgccctggccagcctgcgagtggactttgactaaatgaacagatcacactgcgctctttttgtcatgggactaatcctgtgtccacaaatcaatgccagcgctgacgacctcgcttataacctcgaatttaccggcactattgtggcgcaaacttgcgacatagatatttccagtctcagtcaaagtattgatttagggcagtttgcagttggcgattttccttcgacaggaacaacgacaaaatttaagccctttaatatcaacctcaaaaattgttcccgaggaattaccggggcgaagatctggtttaccggcgaacccgatccggacaatcccgcgctactggcaataaccgataccggaatgggaagcggaaacatgttagcaagcggggtaggggtggaaattctgaatgatgatcaggataccatcagtatcaataatgccgactcagtggtctatccgttgaaagccggacgcaacacgctgtctttttatattcgctataaatcgacccggccgacggtcacgtccgggaacgcgacggcggtcatgtatttcgatatgcagtatgaatgaggagccatcgtaattatgcgtaacgatatcctgtacggcatcgggatgctgctggcggcatccggcgtccaggcgcacgatggccgggtctatgtctccggaaccatcacggacaatacgtgttcgctctctccaggctcggaaaatattaacgtggcgatgggcgcggtttctcaacggcagttttatcgcgcgggcgacggttccgcctggcaaccttttgctatcgatttacagaactgcggtagcactgccagcggcgtaacggtcagttttagcggtgcaggggatagccgtaatacggatttattggcgcttaccgcaggggaaagcgacgcttcaggaattgggattgcgctttatgatcaaaataaaactttaatcccactggggcaggagagtgatgtggtgacgctcagtccgggccaggcgtcggcgcatctgcaattttacgcgcgttatcttgccgatggcggcacggtaacgcccggggacgccaatgcctccgcaaccttcattcttgcctatgaataagttctttttacactgcgcgatatattggtgcttgcttcccatatcatgggcgcaggctggcgtggtaattggcggtactcgctttatctatcatgcgggcgccccggcattaagcgtaccggtaagtaaccattcagaagcgtcctggttaattgatacgcatattttacctggtggccgctggcctggaaccaaaaacgaagggaatattacgcccttcgtggtcacgccgccattatttatgctttcagcgcgccaggaaaactcaatgcgggtggtttataccggcggaccgctacccgccgacagggaaagtctgtttaccttgagtatcgccgctattccctccggtaaaccggaagcgaaccgtgtacaaatggcgtttcgttcggctttaaaattgctctatcgccctgagggactcgccggcaatccgcagcaggcctaccggcatctgatctggtcgcttacccccgatggcgcgacggtacgcaatccgacaccctattacgttacgctctttttattacgcgctaacgagcgcgcccaggacaacgccggggtcgtggctccctttgcaacgcgtcaaacggactggtgccggcacgcggttcgctgcactgtgcgctggcaaagtattaatgactatgggcgggtaatgacagcgcaaaccgtggatctgacgcgtattcattaacctatttttcaggcgtctcccgatagcgggaggctttccgatcttatcgaacgagacttttattatgtattatcacgcgttaaaactttcccgactggcgatgttgacgttggcaggcgttgcagtatccgcctcggcaatcgccgccgattctgccccgacgtcgcaaattggcccgacggcggaagcctacatcgtcagtcatccggataaagtgggagaggtggtggcaacgtatttggccgaacatccggaatttttggtcgccgccagcgagacgttacatcagcgtcagcagattgcgcaacaacaggcgtatgttcaactggcattacagtatcgtgctgagttgctcagtagcagcagtccttccgttgggcccagcgaggcaaaagcggcggtggtaatgttctttgattaccagtgctcgtggtgcagcaaaatggcgcctgtggtcgaaaacctgattaaggcgaacccggatactcggtttattttcaaagagtttcctattttttcctcccgctggccggtatccggactggcggcaagagtcggcgaacaggtatggcttacacagggcggggcgaaatatctcgactggcataatgcgctttatgccacagggaaggtggaaggcgcgttaacggaacacgatgtctacaccctggcgcaacattatctaacgccgacgcagctggccgccgtaaaagaagcgcaaagcagcggtgcagtacatgatgcgctcctcactaaccaggcactggcgcagcatatggactttagcggcacgcctgcttttgtcgtcatgcctcagacgcaaaacggtgatgtaaaacgggtgaccgtgatcccgggaagcacgactcaggatatgttgcaaatggcgattcagaaagcgaaggggtgatattcgctcagaggagaacgcacaggagtgaaagtaaaatgaagtctatgcgttgcgtcataccggtgattttactttcctttatcgttcatgaagggacagcgaaaccgaccgctcagattcattttatgggatcggttgttgaggcaggctgctggaatgacgtgggaaccttagaaattcaatgctataataaagagggagttgaacgttatattattgtcgagaatattatcacgccgatatcgtctcctcatgcaacggtaaaacgagattatttggatgaagataagcaattaacagtgctacgcattgtctatgactgaaccgcgtagcagaccgcaggtggtgtcccgtcagtgtcgtgtgaggatattatgaaaaatgttctcaccttcccgggacacggtctacagactttatcttcagataaacggcgctaaaaagaaaagtacgatcaataaaaaaagagtgggaataccaatagatataattttattacatcggtgagtatgatattgaatagcttgtggcggtatgtcagcagcgtcaatgataaatctttcatcgatttttatcccctgcctggggagcgtaacgaacagttcgaaaagcccgatttgttgtaaatctcgtcgcagcagataaagaagttgcgtcaaattagcatcgctaacaaattgacttcgctctccccaaactgcgtgtgaaatcatctcccgcgtaatcagtttcttgtaggcattttcaaaaagatagcttaaacaacgcgcacgcattagcgtcacctttagcacttttttatcatgtaatgatattatttctcttaacgactcattataaataaattcgttattaatagtatattgtctcatgaattcactccgttttgatattcataaggtacgtttcacactgtcagtgtgttcactggcggtaaagtactccttacatcagtacggataagtgtagagaaccgcaaagaaataagagaatcatttgtgattaaacgggataatattatgcttttttacttttttataaaatgtgccagatgtttttgatgttttttataaaatagcatcatgtgtttttattttacacaggctgaaatgatatcaataaaattataatttaataacaaacagatagaggaaatgatttacttattgaaataagtgtggtgcaaggttaatctgcgccttaaatgatggtgccagattataccagccaggataacctatatgcggccaataaaaaatgctaaaaaaattgactacaatctgatcaaagtgttcgatacggttattactgaaggaaatgcaaccagggctgcgaggaaactggatgtcacgcctgcggcgatctctcaggctcttcttcgtttacaaaatctttatggcgaagagttatttatcagaacccgcaaaggattagtcccgtccagcaaaggtaaatcgcttcaccaggtatttcgccaggcaattgaatctatagaaagcacactgtgcgataaaacagatgcgcaggagagtaatgaactcattgttctgggaagtgatatcactgaaaattactattttccggcattgctggatactgtgttgatgaatcgatatattattaaacactatgcgattaaaaaaacaggggaatactcgccagcctccatgctgacgcatggctatgcggatatcatcatgggaattctggaaattaagaatgagatgatcgaaagttttcttattgataatttatctgattttgtttgtgtttgtggtgaaaaaagtccattggttgggcttgaaaaaatgtctttatataatttttatgctgccagacatgctgtctatcattcagatatgttctcttctttcaatgctgatagcattgatttattcaagagcagtacgccttatgcggggcgcagggaaataggttattatagtgattcactatttggcgttatcggtgttgttgaaaaaagcgatatggttgcgattttgccaggaaaaattgctacttattttagagatgtgcggcgttataatataaaaatactacgtatgcctgatgaaataatttttcgtacattacccgtttatgcttatctggctacaaatagcacccattataaaaatgccaaaaaactgatatcaacatttcagtcgacctttctttttagccaggaaaaacagcctgacgctttggttgaaggaagcacatccttatgcgattgatctgtttaatatcaaattactgtattaaataaataaccattatgaccatggtcagtaaagcaaaaaataatgctatatatttatccccttctttttttaaagaagaggggaggtttttgttttcattgctgataataatgttggcatctactttaatacccgttcgaggcaccgtggaaaaaactggctcaagccaaagcctttaaggtcgcgccgcagtagatataaaatctgggtcaggttggcgtcgctgataaattgacttctttccccccaaagttcattagtgagttgttttttataaataatctcttgttgtgcatgattcagcatatattccagacactttatgcgcattgcggcaatttttattatctttcccgtttttatgttttttagctcattggtcttatcattgtaagtgtgcgtgctgttaattaaataaatagtcatgatgttatttaatgggtttaattggggtagcgataataatatgcatattaaatttgtggatcaactggcgtgattgtaatagcgtcttttttccagagaaaatcgtatcgtgtcacaaaaatgatggttttttagaaaaactaaaattttatttttagtcgttctaaaaataaaatgatagtagtgttaatttttatcagtagattgatatgctttgattgatttattgttgacataaaataatttgaattatggcgcaaggcctatgccaaccataaaaaaggtataggctattagtcacaatgcattaatgctacataattgttatgcttttatattagcgccagggaaataaaatcttcggacaataaagaatagttttagtctgggtgttattttatggatattttattttaaattattaaaccgatttctcttgttgacgtagggttatttgctaagcaacgggctggcttgttgtggccgctcgttgtctatatctgaattaataaggaaaaacgtatgaataagaaaaattcgtcaatggttaacttgcccgcaccgcgtgagtcgattaaccagaaaatcgataccaataacgcattggtgttaaatcataacgccatatatgaacaacgattagcggagatcacgcaatctaatacctgtgacaaggccattgtcaccgtaaatccctacgggaccgccccgttgagtctctatctgggaatttggattgatgaagctgccgcgcttgagatcaatgttgttgatagcgaagcgacgacagaggcagtgcgttatcaatatgatgtacatccgggcgctaaccttattcctgtgtgtgggatggtatccgcggtgaataatcagattaccctacgccttgcctcgcaaattgtcgggcaatatacagtaatgactgacgcattaccgcccacggattcggctaacgtgagcctcggcttccccattattagcgtctcctgtcctgcgcagcaggcctcgctgatggaggaagggctttatttctctacttattttgatcggtataatctggcttttgatcataacgggattgtccggtggtatgtaagtcaggaaatcccttcttataattttgtcagaatggataacggccatttcctggcgacgtcacagggaataaaccattgtctgaatatgtatgaatttgacattatgggacgggtttatacggtttatcttctcgacaatgagttccatcactccattcttcccattgagaacaatctggcgattgcgccttcagaatatagcaatggacggccagatggttactcaaccgggaaagatggcgtttctattattaacttatctaccggacttgaagtcgcctattacgatatgctgtatgtgatggattattccagatcgccgcgtccttccggaagcgcgccaggtcaggacgtatcaatggatgactggctgcatatcaaccaaagctatattaatgaacccaacaatttgctgatctgttccggtcgacatcagagcgcgatttttggcgtaaatgtggattccggcgaactgcgctttattatggcgaaccatgaggattggtctgacgaattcaagcaatacttattaactcctgtcgatgatgatggcgtcccgctgtatgatcttacctcgccgggagggattgatgcggcagataagaatttctggacctgggggcagcataacattgttgaaattccaaatgatgagcctggtattctggagtttatggtctttgataatggtaactatcgttcacgcgaagatgcgaaaagtttgttgccgctcgataacttcagccgggtggtgcagtttaaaataaacctaaacacgatgaccgtaacgcgtccgtatgaatatggtaaaacggaagtcgggaaccggggctatagcagttttgtgagcgctaagcatttattgactaatggtcacctggttattcacttcggcgcgacgacggttgatgagtttgaacataccattaccgcgcaaccaggctccagcgatcttgtcgatccggatgaagggcaacaggcgttaggtcgactggtattacaagaaatcaataaagagacgaaagaggtcttattcgaagcgatggtgacgtcgggctatttcaagaacgaagagacgaatggcacgaattatcgttatgatatttctgcatttcgggtatacaaaatgccgctgtttgcataactaagtatgttatgcggccggttatcgaccgcataacattatggcttatttgctaatatcatccacgcgcatggtgtggtcaggttgaatattgttaacctgcttcatatagttaaccaacgccggtgcggtttgtatccctatatatttgatatttttacctttagtgaaggtaaatccgccaccacctttaccgataaaggaatccagcgcgacggtatagagtttattgtcttctaccggtttgcctttgatatcaaattcaacaatacgctggcccagcggtttggtactgtcatatttaaactggacggttttagatacgtgcagcataccgtttttcagatcggcagcgtgtgacatgatggatttcaggtccttaccgctgatttccatgctcatgacatcgttggtgaacggatacatactcagcacatcaccataggtgatattacctttaggcaattcggtacggatgccgccagcattatagaaggaagcgtcggcgccaggaacggtagccatcagggcatcggtgattaagttgccggttggcgcggattcaccgtaagaacgggtcagcacttccggagagtgcgcgaccacttcatcggtaattttcttaaccttgttatcccattcgtcaattttggcctgcgtgaccggatctggcttataagtatccgcatacatggtgatcaacttaccattgtagctgtccacttttttggtttccgggttccagtcaagcaccagtttacctaattcgatggtgtacgcatccgtggaaacgacaagagtatcgcccactttaatcggttctggcgtacctttatgcgcatggccggtaatcaggacgttaagtccatagccttccagcgatttcgccatatcaacgtcggttttcagtgcgcgtgcgacatcagcctcgcccgcgctggactgcatacccggcacgccttcgtgggcgagcagcacggtcaggtcaactttcccttttaactcttccagctgttttttcacataaggaatcggatcgcggcagtcaacgccttcacgcacgcctgcggcaatcgcttcatagaatgcggaaacgccgtgcataccgatgacgccgatcttgaatccatctttttccacaatggtatacggttctttaattaatggcgtatctgtgccgctgtaaaaaacattatccaacaataccgggaattgcaatttgctgagctgtttaaccagattctcatggccatggtcaaattcatggttaccgacagagacggcgtcgtaaggcatggtatttaaaatatcaataatagcctcgcctttggtcagcgtactgataaaaggtccggtgaaatagtcgccagcatcaaagaaaaagacatctttctctttcgcttttgcatctttgacaattttcgagatgggcgcaaagccgcctaccggacgtgtcttggatacataggggataatttctggggttacatgggcatgtaaatcgttcgtataataaattgtgatgtcacgcgcatcggctgaaaaggaaatggctgaagacaaaccaatgcacagcgacagtagggatatcgaaaactttttgttcatataaaccatccatttacgctacattaaagaaaaacaatgcctgtagtcgtgtcattcacgactacaaaccggggaaattaagtaatattcatcaagtttattaattattaaaacttgaagccgatcaggtaattcatacggtcgccgtagccgttataccccaatttattattgaagtaacggtaagagacggaggcggtccatcgcggcataaatttccatgtaaacgttaccgcgccgttcaggccggtcgtcccaccctgttgttcggcgtaggcatcattacgatccatttcaacttcgttccagtttgaaatgacgaacttttcattaaacatatcgaagttataagccgcgacccaaccgagaacataaccgttaaagcctgtcgcctgtccatactttttagaggtataatcgttcgataagttatgaacagcgaaatagggcttaataaagcctgatgggctggttaaacccagataacctaccccgtacatcatgtttaattcatcaccgaatttattctccatcgacatatagagtttcatcattgcggtaaagttagagccttctactaccctataatgtcccagaaattgggtaacatggttacggccttctaccggatggttgagcacgttcatttcataaaatgatgcaaattcgcccctgtcaaacacggcgccgaaatcggctaccgctttccacacttcgccgcgatcgacattgacaaagcctttattccagtcgccatatccgaagctaagtttaccgtatacgcgtttcaattccgctgcctggccattaaagcaagagaaaagaacacatgcggcgagtagactattaatatatttcttatttttcatgctcaactccatgaggtaaaaacacagtgaaatgttgtgtaaagaagcgaattctaaggagtgtctttttatacgtaggtgatagatgtctcaaaaatatcagcgacatataatcgtcaaatattcgtgtcagataatgttgtttattacgtgataactatttgatttatagtttatgtctctgttgtaaaagtcacaccggatagcatgaaattaatgaaacttcgaatgggaataatctctcgcaaagacaacttactgccattaaatgagggtgttaccgttcaaacagcaacatatattgacatcacaatagcggttctgacatatgggccatatttgagatctgcatcactcgttcgcgatttctttttttatagactgcttcaggcgtgttttctttagcacgaaatatatttatggtattaatattataatgagtgtgaataatttctacgataaaacgatgttaatggaagaaatataagataaatcgaatatatatagtgcaattaatttaggctgtattccgcagccgggtctatcggcaaatatatcgtaatcagaccgtgcgataactcaaaggagttgaaatgaaaagaacagtcgttgccagtatgatagggttggcgctatgcgctggatgcgtattatcaaccgcgcaagcggcaaccgcaaagcgtcctaacttagtcattattctggcggatgatttagggtatggcgatctcgccacctacgggcaccgcatcgttaaaacacctaacatagacaaattggcgcaggagggggtgaagtttaccgactattatgcgccagcgcctctgtgttctccttcccgcgcgggcctgttaaccggtcgtatgccgttccgtaccggaatccgttcctggataccggaaggcaaagatgttgcgctggggcgtaatgaactgactatcgccaatctgctaaaacagcagggctacgatacggcgatgatggggaaattacacctgaatgcgggcggcgatcgcaccgatcagccgcaggcgaaagacatgggctttgactatacgttggttaatccggcgggatttgtcaccgatgctacgctggataacgccaaggagcgcccgcgctatggcgtggtgcatcctacggggtggattcgtaatggccaacatattggccgcgcagataagatgagcggcgagtttgtgagctctgaagtggtgaactggctggataataagaaagacgataatccgttcttcttatatgtcgcctttaccgaagtccatagcccgctggcgtcgccgaaaaaataccttgatatgtattcgcagtacatgaccgactaccagaagcagcatccggatctgttctacggcgactgggcagacaaaccgtggcgcggcaccggcgaatattacgccaatatcagctacatggatgagcaggtcggtaaagtgctggataaaattaaggcgatgggcgaggaagataacaccatcgtcatctttaccagcgacaacggccctgtcacgcgcgaagcgcgtaaggtatacgagctgaaactggccggggaaaccgacggtctgcgcgggcgtaaagacaacctgtgggaaggcggcattcgcgtaccggcaatcatcaaatacggcaagcacattccacaggggatggtaacggacacgccggtatatggtcttgactggttgccgacgctggccaacatgatggactttaaactcccgaccgatcgtacctacgacggtcagtctttagttccgctcctgaaggacaagacgttaaaacgccagaaaccgctgatcttcggtatcgatatgccgttccaggacgatccgacggatgagtgggcgatccgcgacggcgactggaagatgatcatcgatcgccagaataaacctaaatatctctataacctgaaaaccgatcgtttcgagacgctcaatcaaattggtaaacagccgcagattgagaaacagctttacggtaagttcctgaagtataaaaaggatattgataacgattcgctgatgaaagcccgtggcgataagccgacgcctgtcacctggggctaatggaataattataaaaaattaagtatgccacttagggcgatgcccacctgatccggtcactctgtgccggatcaggttcttttatttcagggaaggtaatgatgtttgggaaaagttgtcaggtcatggttaaaccaaccggatcggtgtgtaaccttgactgtaagtactgtttttatctggagaaagaaaagctctatccggatcgaaaaaaccattacaaaatgtcggaagagaccctcgaactcttcatcaggcagcagattgccgcacaggatattgatgaggtcatttttgcgtggcagggcggggaacccacattaatgggcatcccgttttatcgtaaagccgttgaatttcagcagcgctattgtggcggcaaaaccatcgtcaataccttccagaccaacggcatcctgatcaacgatgactgggcgaccttcttccgggagcatgattttctggttggcgtctctattgatggcgatgccgcgttacacgatgaatggcgagtgacgcgctccggaaagccgacgcatgaaaaagtagaaaatgcggtgcgttgtctggcgcagcacgacgtagaatttaataccctcacggtggttaaccgtaccaatatgcatcatcctgttcaggtctatcgctacctgaaaagcgttggtagccgctatatgcaatttatccctttagttgaacgctgtggggaaaatgggctggcgcagccgcaggataaacatatcgcgatgacgccgtggtcggtcgatagcctgcaatttggtcagtttctgaatgcggtatttgatatctggatccgtgaggatatcggcgatatcggcatccagctatttgaacagacgctggcggcctggtgcggcctgccgccgcaggtttgcgtttttgctcccacctgcggcagcgcgtttgcgatggaaatgaacggcgatgtttataactgcgatcacttcgtatatccgcaatttaaactggggaatatccaccagaagacgctgcgtcaaatgaatcagggcgaacaaaatcgccagttcggcagcgataaacagcgttcaatggcgcaggagtgtcatcgctgtcaatggaagttcgcctgctatggcggctgtccgaaacatcgttttttaccctctgcgtcaggcgcaaccaatcataactatctgtgtgcaggttatcaggcttttttctcgcataccgcgacggcgatgagtgccatgcgaaccctgtatgaaaaaggcatctcacttgcagaaataaagtcaatatttgtttgaaggtagtattcgcagggagtgaatatgttttctcacattaatgtcgatgcttgcaaaacgccaggctgcaaaaatctggggattctggggagcccagactatctaccgcaagggaaaaatgttctctgtcgagcgtgcggttttttgttccccattatctcagccagatcgcttaatctttttcgccaggcggcgaatcaaccctggaaaggtctggtgaagtcctgtccgcattgtggcgggacgtcgctgaaaaatatggattttccactaaaggtgaacggcgtatgtattgccgccagtgtaataaaacgttcatctcctataccgctatcaggagcgacgccagacaagagaaccttgccacgttgattggcgaaggagcgtcgctagttgaaatacgcgcggcgctggcgatagacagcacgggttttagccgcgaattacaaaaactgtcccgtcgcgctaatcaagcggaacgcgattttgtgtttcccgcgtttgatatcgctatgagcacgcgggcgtttcgtgtgaaatttaacggcggcgacagcagcttatatgtgctggtgacggcggaagaggagagcggtaaggtcgttgcgatctcaacgaattactccgcccaaccggtggaagcggattatcaatatcattctgattacgaagaacgacttccgtccggcacgctggcgcatctggtgcagcgaaaagaggcgctgaccatgcgccgcaatgtattatttgatgtggattacggccccgccattttatataaaaacgatccggggatgttagtaaaacccgtattacctgcttatcgacattttgagttggttcaggcgttgacggatgagcgctccctgaatgtccagcattatctcgatcacgaatgctttattctgggcggctgtatgatggcgaattttagctatcttcgtcaggggcgctgccatatttcgtttgtgcgtgaaagaggcgttacgccgcccaaacgcgatctccctccgcggttgtttttgagcggcggaattcgcaacaacgtctggcgtacattttccacacgggattatgcgatggcagtatgcaatctcacaggaaataaaaaggtgagtttgttacgtcatgcgacgttaaatagcgcgacggcgtttattcgctatgttcacaaccatcccttcctgccgcatcttaaccggatgtctcctggcaatgttgttgccgtactggattacctaaaatttgaatatgacgcttcatgtaactgaattgctaaaataaaaagtgtgatgaggtgttgttgcggtattttattcggacggcttaaaaatccagagtattaattttcgtggtccccatgaggggcgatgagattaatacactggagatttatcatgaatacgttaactgcaacgtctgttgtccttcctgcgccgcgtccggcgattaatcagggtatcgatatcaataatgaaatagtgcttaaccataccgctatttatgaaaattgccttgcgcaggtcacgcaagagaatacggtagaaaatgcgctcatgttgttagacccttacggcacggcacctttaagcgcctatgccggcgtctggagtctggaaccggctgagatcatggtcacggtccaggatgcggcaaaaacggcgatgccggtagaacatctttacacccttacggcaggcgcaaatctgttgccggttctggggctggtagcggagactgaaaaccgtattgtcttttctcaggcagatacgccgcttgccgtctatacgctcaccacacagccgttaccgccggtagattccgcggaggtcgtattaggttttccgattatcaacgtgacgcaacctgctaccgatgtggacaagatggcgccagggttttattttgttacgcatttcgatcgctataattacgcattagatcagaatggtctggtgcgctggtacgttactcaggattatccgtcttataattttgttcgaattgataatggccatttcctcaccacttcagaagcgaaaaatacctatctggatatgtatgagttcgacatgatggggcgtcttcacacattctataatctcgataaccaatttcaccattctatctggccgtgggacagtaataccattgttgcgccctctgaatatacctcgggtcggcccgacgatttgaaaaccaatgaagacggcgtatcggttgtcgatctggctaccggactggagacggcttactacgatatggcgaaggtgttggatacgacgcgggtttcccgtccttcaggtacggcgccgggagaagacccgacggttaaagactggctgcacataaaccagagctacgtgaatgagacgaatcagttgttaattgcgtccgggcgtcatcagagcgcggtgtttggcgtcgatctgcaaacgcaagcgttacgctttattttgtcaacgcatgaagactgggacgacgcttatcagccttatcttttaaccccggtcgacagtgaaggtgtggcgctttatgactttagcaaacaggaggatatcgacgcggccgaccgtgacttttggacgtggggccagcataacgtcgttgaaatcgccaataatacgccgggtatagtggagtttatggtatttgataacggtaactaccgttcgcgtgatgacagcaaaagcctgttaccgccggataactacagccgcattgtccatttcgtggtgaatatgaatgagatgaccgttatgcggccatttgaatacggcaaggagctgggcgcgcgtggctacagtagctgcgttagcgcgaaagcgatccagcagaatggcaatattgtggtgcattttgccgactgcacgtttgatgaaaatggccgcgccatctcttgccagcctggcgagagcgatattatcgatccgcaggcgggcagcgaggcgatggggctgctaattttacaggagattgcgcctacggagaaaaccgtgctttttgaagcgactatgacgtcaggttactacaaaaacgcggaaacgaacggggaaggctatcgctacgatattaccagtttccgggtgtataaaatggatctgtacgcgtagcggtctatcatcaatgactgactgcactaaaaaagtccggcgtaagtcggacttcatttcgtaaaaaacgagctattcatcatatataatctaattttaacgatgagtcaggcgaggtaagatagtagatccgaagaattcacctgattgagagaataaaaagtgaaacatctgcaccgattttttagcagcgatgcctctgggggcatcattctcatcatcgccgctgcgctggctatgctgatggccaatatgggcgcgaccagtggatggtatcatgattttctggagacgccggttcagctacgggttggggcgcttgagatcaacaaaaacatgctgttgtggatcaacgatgcgctgatggccgtgtttttcctgttgattggcctggaagttaagcgcgaactgatgcaaggctcgttagccagtctgcgccaggccgcttttccggtgattgccgccatcggcgggatgattgtaccagcattgctctatctggcctttaactactccgatccggtcactcgtgagggctgggctattcctgccgcgacggatatcgcctttgcgctgggcgtgctggcgctgttaggcagccgggttccgctggcgctgaaaattttcctgatggcgctggcgatcatcgatgacctcggcgccatcattattatcgcactgttttataccagcgatctttctatcgtctcgctgggcgtggcggcgttcgcgattgccgtgctggcgctgctgaacctgtgcggcgtcaggcggacaggggtatatattctggtcggggcagtgctgtggacggcggtactgaagtccggcgttcacgcgacgctggcaggcgtcattgtcggcttctttattccgctgaaagaaaaacacggacgctcgccggccaagcgtctggagcatgttctgcacccgtgggtcgcatacctgatcctgccgctcttcgcttttgcgaatgccggcgtttctcttcagggcgtcacgatggacggtctgacctccatgctgccgttgggaattattgctggtctgctgattggtaagccgctggggattagcctgttttgctggctggcgctgcgtttcaagctggcgcatctgccgcaggggaccacttatcagcaaatcatggcggtcggcattttgtgtggcattggctttacgatgtccatctttatcgccagcctggcatttggcaatatcgatccggaacttattaactgggcgaaattgggcattttgattggttcattgctctccgcagtggtggggtatagctggttgcgcgcgcgtttgaacgcgccggcataaccagtacgaagggaagggggagcgatgtatcgctcccttacgacattgagcagggagagaaatgagcatgtctcatattaactacaaccatctttattatttctggcatgtctataaagaaggttctgtcgtgggcgccgcagaggcgctttttctgacgccgcaaaccattactggtcaaattaaagccctggaagagcgtttacaggggaagctatttaaacgtaagggacgcggtcttgaacccagcgaactgggcgagctggtttttcgctatgcggacaaaatgtttacgctaagccaggagatgctggatatcgtcaattaccgcaaagaatcaaacctgttgtttgatgtcggcgtcgccgatgctttatccaagcgtctggtcagcagcgttctggatgcggcggtggtggtggacgaacccatacatctgcgttgcttcgagtccacgcacgaaatgttgctcgaacagctcagccagcacaagctggatatgattatctccgactgcccgatagattccacgcagcaggaggggctattctcagtcaaaatcggcgaatgcagcgtcagtttctggtgtacgaatccgcttcctgaaaaagcgtttcctgcctgcctggaagagcgacggttgctggtgccgggacgtcgctcaatgctggggcgtaagttgttgaactggtttaattcgcaggggttgcaggttgagatcctcggtgaatttgatgacgcggccttaatgaaggcgtttggcgcgacgcatgatgcgatttttgtggcgccgagcctttattcgctggatttttatgccgatgagtcggtaatagagattgggcgcgtggagaatgtcatggaagaatatcatgcgatttttgccgagagaatgatccagcatccggcggtgcagcgtatttgcaatgcggactactcggcattgtttaagctacagtagacatacctaccgtaatacttccggctgcggaactaacccgcagccggaatcattctacaagttcagtaggctacggtactgcccaccttcgcggataaacaccggaattctgttcagtggcgtagcgtaatgcagcgtctgccctcctgaatagctttcaccggtcgcaagatccgtccatgtttccccttctggtagccagacatcacgttcgcgcataccttcatgcatgacgggggcgatcagcaggtcaggaccaaaacagtactggtcggtgattgtccaacttgtttcctgttcggggaattcaaagaacagggggcgcatcactggcgtattgtgcttatgggtttcctccatcagcgctttgatatagggcttgagtttttctcgcaacgctaggcaacctgtcagtacgtcgcatacttcctcaccgtagctccagacctcgttcggcgcacctgtagggcactgggcgataccatcccgatacggttgcgcgggtaaaatttgcggatcgcggttgccgtgcagacgcatcaccggactaaagacgccccactggaaccagcgaatcagcaattcatggaatttcgggtcgtgaatattaccgccatggaaaccgccgatatccgtcgtccaccacggtatccctgctattcccatattgagtccggcggcaaactggttgcgcagcgatctaaacgaggagtgaatatcccctgaccagaccagagcgccgtacttctgactgccggcccaggcgcagcgtagcaggttgataacctggtcttcgccatcggctttcatgccatcaaaaaaggttttagcgtacatgcgtgggtagatattgcccacttccagtaccggtccggcatggtagcgatagttgtcgtagtcgtaaacgctgaactcaggttcggcttcatctaaccagaatagcttcacgcctttatcgtgatagttgcgtttggctttgccccagacatagtcgcgcgcgcccggatgagtcgcatcaaagtaagtggtattgccgaggaaatccatattgatcggcaagccacgttccgtttgtaccagccagccgttttcacgcatctcccgatagctttcggtgcggttatccaccgtcggccagacggagaccatcagctcaattcccagcgatttcagctcggcaatcatggcatcaggatcgggccagtcgcgcgcatcgaacatccagtcaccctgattcggccagtgaaagaagtcgataacgatcaccgagataggtagattgcggcgcttatattcgcgggcgacctccagcagctcttcctgcgtacgataacggagtttgcactgccagaagcccatggcgtagtccggcatcatcggcggcgtgccggtagccagcgcgtaagcccggccaatttctgccggggtatcgccagccgtgatccagtagtctaactgttcgctgacctgcgcttcccattcggtaacgttttgggcaaaggttacgcgtccgactgccgggttgttccataaaaatccgtagcccagactggagagcataaatggtactgaggcctgggagttacgttgcgccagctcaagcacgcatcctttgagatccaggttggcctgttgatactgccccatgccataaattttttccccttcggtggcttcgaagcgggctttcagtgaatatttcccaccctgaatcgggcggaactcgcgtccctcaaggttgagtgcgctgacgtactggccgtgagatgattcatcctcgccaatttcgccccgcaggcgccaaaactcctgcaacaggggtttgtgtggatggcggtaaaaggtaacttgtcctttttgattgacgatagcgataattttgccgttggtcagcgttgcttggtggtgctcataatcaatgtggcactggctttctgcgactggctcagtcaatgcccagtcttcatttctcattaccggcagatgacggccactgcgtacgcgcaggctgttctcgccccagggttcaatccataaatagcgatcgttttgctgccagaccagacgacgtgggtcttgttgcataaatggcatggtggtgcctcctatattcgagggtgaaggtaaagaacgttatgagttgatggtttccagatcgtggcgaatcttctcttccatcgcttcgtatttgcgaaagaaaagtaatgggatcgctgcgagcgcgaagagtagggcgggtgcccagataaaggcccaggtaattccctccagacccgcagcactctgggcatggttggggacatagccaaaactgttcatgatccaggcggctaaagcagtaccgaggccactacccatcttgatgcagaaggtactgccgaaggcgataagaatgccggtagccttaataccggtcttccaggcgccgaaatcaacggcgaagcccagcatggcaaatggcattgagcaggcgataccgctgccgatattgccgagtatccaggcggcgatgaggaaagtaatgttgtccgctgccagccacatcatgacgccgccaaacgtggcgaccagcagaccgcctacccatatccaggttttagccaggtatttgctaaagaaggggatagcgatgataaacaggatctgaatcgtcgccaggctgttaatcagcggcaccagatctttacggtcgaggttgtaggtcagataatagacaatggtcgtggagcgctgctgtagggcaatccagaagatcagattagccagcaccatcagaatccatggccagttacctttcatcgccgcgaaactttttttcatcggcaacttaggttcatgctgtattttatccgcatccatttcacgaatgtttttaaacgcaaagagcgttagcgcgcaagatataatggcaaatgtaatcgccgtataaataaaaccagcgtgatcatcaccgttacctaaaaaagcgactaacggcaaggcggtcgcgttcattaataaaaccccaatttgcccaccggtcattcgccaggaatttaaaaccagtctttccttgggagataaggtcatcaggggtaatattgcactgagtggtgtattaagtccggtaaatagaatgctggcaatcatataagatattgctgcatagatggcttttcctgttatactgatatcaggagaccaaaatgacagcgcgctgaataccgcaaaaggcagcggtaaccataaaaaccagggacgacatttaccgtagcgtgaacgcgttttatcgatgatgatcccccatataggggcgtctatgccatcgacaatacgcgccagcagcaggataatgcctgctacggcaaggctaatgcccgcaacgtctgtatagaaatataaaatgtacgttgaaccgaagcagtatagcagattacccgccacatccaaagagccgtagctaatacgctgtagtaaagacaatgatgctgacccggaaggctgggtatcctcaatgacagaactcataatgataactccgatattggtacgatacgcccagaaaaacaacctctactttctaagcaagttttgaatattatttttatgtcgtttctgaatttaacctcagattaaaatgagtaagtaaggtgtacatgaaaagtagttaacccgacggcatcaatcaattattaaatcttacatcaggattgcgtttattagtttttaaatgagcgatgtttttatttgctaaggtggtcacagttttttcagtaatgaaataagaaaaggaaaacagtgaaagaaaataactttcaagtattacgtgactaagggagggatagctgaaaaaataggctggcacaggaagagcgtgaacgagtgaggtcagcgccagcggttgacgagaaaaacggcagatagcaggcataaaaaaacccgctttacgcgggtttttctacaaagctgataacaagcaggcgattaagccagtttgttgatctgtgcagtcaggttagctttatgacgtgcagctttgtttttgtggatcagacctttagcagcctgacggtccacgatcggttgcatttcgttaaatgctttcagtgcagcagctttgtcgccagcttcgatagctgcgtatactttcttgatgaaagtacgcatcatagagcgacggcttgcgttgtgcttacgagccttttcagactgaacggcgcgcttcttagctgatttgatattagccaaggtccaactcccaaatgtgttctatatggacaattcaaaggccgaggaatatgcccttttagccttcttttgtcaatggatttgtgcaaataagcgccgtttaaattgcagcactcgttgcgtagtgatggcgcaggattctaccagcttgcgtgctgtgaatacagcctttccatgagaaaaattgcattaagcggcgggttttggggcggagtttgccgcatggcgatgaaaagcatcttctttatgtttcatcagggcaatcgccggttaaccttaaccgctgtacaaggtatactcttgcgattttcactgttttgagtcagacatgaagctgatacgcggcatacataatctcagtcaggccccgcatgggtgtgtgctgaccattggtaatttcgacggcgtacatcgggggcatcgcgctctactgcagggtttgcaggaagaaggacgcagacgcggtctgccggtggtggtcatgattttcgaaccgcagccgctggagctgttcgcaacggataaagcgcccgcccgcctgacgcgcctgcgtgaaaaactgcattacctggcgcagtgcggcgtggactatgtgctatgcgtgaaattcgatcgccgctttgccgctttgacggcgcaaacgtttatcagcgaactgctggtggagcgacttggcgtgcaatttcttgccgtcggcgatgatttccgctttggtgctagccgcgcgggcgatttcttgttattacagaaggcgggggcggagtatggttttgcggtttccagcacccaaaccttttgtgaaggcggcgtgcgtatcagtagtaccgcagtgagacaggcgctggcggaagataacctggcgcttgccgaaagtctgctgggacatccctttactatttccgggcgtgtcgttcatggcgacgagctgggacgtaccattggcttcccgacggcgaacttaccgctgcgccgtcaggtctcaccggtaaaaggggtctatgcggtggaagtcaccgggcttggcgataagccgttacccggcgtagcgaacattggcactcgtccaacggtggctggcgtgcgtcaacaactggaagtgcatctgctggacgttgtaatggacctctacggtcgccatatagatgtaatactgcgtaaaaagatacgtaatgagcagcgatttgcgtcgcttgatgagctaaaagcgcaaatcgcacgcgatgagttaacggcccgcaagttttttgggctagccgggcaggtgtaaccctgacggtgtttatcaaaccgaaatacggaaccgagaatctgatgagtgactataaatcgaccctgaatttgccggaaacagggttcccgatgcgcggcgacctcgccaagcgtgaaccgggaatgctggcgcgttggaccgatgatgatctgtacggcatcattcgtgcggccaaaaaaggcaaaaaaaccttcattctgcatgatggccctccatatgcgaatggcagcattcatattggtcactcagttaacaagattctgaaagacattatcgtgaagtccaaaggactgtcgggatttgactcgccttacgtgccgggctgggactgtcacggtctgcctatcgagctgaaagtcgagcaggagttcggtaagccgggcgagaaattcaccgccgctgaattccgcgccaagtgccgcgaatatgccgccactcaggttgacggccagcgtaaagacttcattcgtctgggcgtgttgggcgactggtcgcatccgtacctgaccatggacttcaaaaccgaagccaacatcatccgcgcgctgggcagaattatcaaaaacggtcatctgcacaaaggcgctaagccggtgcactggtgtgttgactgtcgttccgcgctggcggaagcggaagttgaatattacgacaaaacgtcgccgtctatcgacgtggcgttccgtgccgtcgatcaggatgcggtgaaagcgaagtttggtttgccgggcgtgagcggccctgtgtcgctggttatctggaccaccacgccgtggacgctgccggctaaccgcgccatctccctggcgccggactttgattatgcgctggtgcagatcgacggtcaggcggtgattctggcgaaagatctggttgaaagcgtcatacagcgtattggcgcggctgaatacaccattctcggcaccgtcaaaggcgcggagctggaactgctgcgctttacccatccgtttatgggctttgacgtgccggcgatcctcggcgatcacgtcaccctggatgctggtaccggtgccgttcacaccgcacctggccatggcccggacgactatgtgattggtcagaaatacggtctggaaacggctaacccggttgggccggacggcgcttacctgccaggcacatatccaacgcttgacggtgttaacgtcttcaaagcgaacgatatcgttattgaactgctgaaagaaaaaggcgcgctactgcatgtcgaaaaaatgcagcacagctatccgtgctgttggcgtcacaaaacgccgatcattttccgcgcgaccccgcagtggttcgtcagcatggataaagaagggcttcgtcaacagtcgctgaaagagatcaaaggcgttcagtggatcccggactggggtcaggcgcgtattgaatcaatggtcgctaaccgtcctgactggtgtatctcccgtcagcgtacctggggcgtaccgatgtcgctgttcgtgcataaagaaacgcaggagctgctgccgattgagcgtactctggcggcgatggaagaggtggcgaaacgcgttgaagttgacggtatccaggcgtggtgggatctcgacccgaaagagatcctcggcgaagatgctgatcaatatgagaaagttccggatacgttggacgtttggtttgattccggttccaccagttactccgtggttgacgcccgtccggaattcgccggtcacgctgccgatatgtatctggaagggtctgaccagcatcgcggctggtttatgtcctccctgatgattagcgtggcgatgaaaggcaaagcgccataccgccaggtactgactcacggcttcaccgtcgatggtcaggggcgcaagatgtccaagtccatcggtaacaccgtgtcgccgcaggatgtgatgaataaactgggcgcggatatcctgcgtctgtgggtggcgtctactgactataccggcgaaatggcggtctctgacgaaatcctgaaacgtgctgctgacagctatcgtcgtatccgtaataccgcgcgcttcctgctggcgaacctcaatggcttcaatccggccaccgatatggtcaaaccggaagagatggtggtgctggacaggtgggcggtgggctgcgcgaaaacggcgcagcaagagattctgaaggcatacgaagcttacgacttccatgaagtggtacagcgcctgatgcgcttctgctccgttgaaatggggtcgttctacctcgacatcatcaaagaccgccagtacaccgcgaaggccgatagcgtcgcgcgtcgtagctgccagactgcgctgtatcatatcgcagaggcgctggttcgctggatggcgccgatcatgtccttcacggctgatgaaatctggggctacctgccgggcgagcgtgaaaaatatgtcttcaccggcgaatggtacgacgggttgtttggcctggaagagaatgaagaatttaatgacgcattctgggacgatgtccgctatatcaaggaccaggtcaacaaagagctggaaaatcagaaggccaatggcatcaaatcgaacctggaagcaaaagtgacgctgaaatatgctgacgatgctaacggtacgatcaagaagctgaaactgttgggcgaagaggtcagatttatcttcattacttcccagttcgtgatttctgagcaagcggggggtattgatgatgaaaatattcagtacaatgctggtaatacgacagttcaggcagtggtaacgcgtgccgagggtgataagtgtccgcgctgctggcactacactactgatgtcggcaaggtggcggaacatgcagatatctgcggacgctgtgtcagcaacatcgccggtaatggcgaacaacgtaaatttgcctgatgagtaaaccactctgttcaacaggactacgctggctatggctggtagtagtcgtgctgattatcgatttgggcagcaaatacctgatcctccagaatttcgctctgggggatacggtagggctgttcccgtcgcttaatctgcattatgcgcgtaactacggcgcggcttttagcttcctggcggatagcggcagctggcagcgctggttctttgccgggattgcgatagggatctgcgtaattcttttggtgatgatgtatcgctcgaaagcgacgcagaagctgaataacatcgcttatgcgctcattattggcggcgcgctgggtaatttgttcgatcgtctgtggcacggcttcgttgtcgatatgatcgatttttacgtcggcgactggcatttcgcgacgttcaaccttgccgatacggcaatttgtatcggtgctgcgctgatagtactggaaggctttttgccgaagccgacagcgaaagagcaggcataagcgtaaataccgggttgcgcttatccggttttgtaggcctgataagcgcagcgccatcaggcaaacgtggtgccggatggcggtgaaaacgccttatccggcctacggttttatcgttctttgtgcctccgggcaaaacacgtgagcaatttgcatgtctaaatccgtacagagcaacagcgcgatcctcgttcacttcaccctgaaactggatgatggctcaacggcggaatctacccgcaataacggcaagccagccctgttccgtcttggcgatacctcgctttccgaaggtctggagcagcagcttctggggttgaaagaaggggaaaagaaagcgttttcgctggagcctgacgccgcgtttggcgtccccagtccggacttgatccagtatttctcgcgccgtgagtttatggcggcgggcgaaccggaagtcggggcgattatgctttttaccgcaatggatggcagcgaaatgcctggcgtgattcgcgaaatcaacggcgactcgattaccgttgattttaaccatccgctggccgggcataccgttcactttgatattgaagtgctggaaatcgatccggcgctggaggcataaacatgcagatcctgttggccaacccacgcggtttttgcgccggggtagaccgcgctatcagcattgttgaaaatgcgctcgccatttacggcgcgccaatttacgttcggcacgaagtcgtgcataaccgctatgtagtggacagcctgcgccagcgcggagcgatctttatagagcaaattagcgaagtgccggatggcgccattctgatcttctccgctcatggggtttcccaggcggtgcgtaacgaggcgaaaagccgcgatcttaccgtttttgacgccacctgcccgctggtgacgaaagtccatatggaagtggcgcgcgccagccgtcgcggtgaagaatctattctcatcggccacgccgggcacccggaagtggaaggcaccatgggccagtacagcaatccggaaggggggatgtacctggtggagtcgccagaggacgtctggacgctgaatgtcaaaaatgaaggcaagctctccttcatgacgcaaaccacgctttccgtggacgatacgtccgatgtgattgatgcgctgcgtaaacgctttccgaaaatcgtcggcccgcgcaaagacgatatttgctatgccactactaatcgtcaggaagcggtgcgggcgctggctgagcaggctgacgtagtgctggtggttggctcgaaaaactcttctaactctaaccgattggcggaactggcccaacggatgggaagaaccgcgtttcttatcgacgatgcggcggatatccaggaggcgtgggtgaaagacgccgcctgtgtcggcgtcaccgctggcgcttccgcgccggatattctggtgcagaatgttattgcgcgtctgcgggagtttggcggcggcgaagctgtcacgcttgagggtcgcgaagaaaatattgttttcgaagtaccgaaagagctgcgtgtggatgttcgtgaagtcgaataagatttcacaattcagaaatctgcccgatgatgctacgctgaccagatcttaagaatttcttttgatattcaatgtgcgacaggaaaaataaggcgtagtcgtcatccggtgctaatgccccacctttttgctattcatctgaaaaaccagcacaatcgttgctggtttttgggttgtaatgcctacagggataagggaaatgggcaaaataaaatatagattgccaacgttactcgccatcggcttttggatggacgcggcaagcgctacggtgctggagctacccgcctgggagcgaaactataccgggactatcgcggggaaaccggtaaacgttaatatcacgcgatttggtaacacgctttatgggcattactgctatgaaccttgcaatcagcacaaggcagtgattgttctacgcggctcactccaggataaagaggtgcatcttgaagaacgcgtaaaggcgctttcgggttactggaatgcggaaatctccagcagtgagattaaaggcgaatggacgtccgcagataaaaaacgacattttcctgttgcccttatctattacaaacctaaaaactcccctgatattgtgctggtcacgaacacgaatgatgcagggggttacgacccttccaaagagattgattgcggcaatacgccggccatttcggcgataaaattataccgtgatggtaaactcatacagaccttagataccgcctcggtgggcacctgtagcccgtttatgcctcaatggggggatgtcaattttgatggctacccggatctatcgattgtaacagagttacttgctgggccggatgctccagtacaaacatggctctatgaccccgccaagcagcgttatgttgatgcgcccgcgtcttatcaggagatcacttcaccagagatcgatgctgaacataaacagattgtcagctattggcgcggcggttgctgcagccatggcgtcaatgtgtatcgctggaaaggaaaaacgattgaactgatcgatcgcggtgaaagctactttcagcctgtgataagtaaaggcaaaatgtataactgctacatgacaccttcctacgctgatgggcgtattatttatccgctagtacgtaaaaatggtcatttgacgccgcctcttagccttgatgggacgtgtcaatctttttggctaaccggtaatgttcgtaccgtgattcaggcagaaaaacccggcgctgagcccgaatcgcttgagattcagtggcaggaaaacaaagcatcgccagggcgtttttgcccattagttccgtttgtcgaaggtgataagctaagtccgcgtctggtgacggatgacgatgtgcctgatacctgtatcagtcgcgctgagtatgaagatataaaacaataggtcaggagagcgttaatgacagcatccctacacattattcttgataccgatccgggcattgatgacgcggctgcgattgccgctgcgctgttcgccccccagcttgatctgcaactaataaccaccgtcgcaggcaatgtttccgttgaaaaaacgacccgtaatgcgttgcagcttctgcatttctggaacagcgatatcccacttgcccagggggccgcgacgccgctgctgcgtccgttacgcgatgcggcatacgtccacggcgaatccggtatggaaggctatgattttgtcgaccatcagcgtcaaccgttggcgaagcctgcgtttatcgctatccgggatgtgttgatgaacgccccggagcccatgacattggtggcgattgggccattgaccaatattgcgttgctactgatgcactatccggagtgtgcgtgtaacattcgccgtctggtgttgatgggcggttccgcagggcgcggcaattttacgcctaatgctgaatttaacattgctgtcgatccggaggccgcggcgctggtgttccgcagcggtctggagattgtgatgtgtgggcttgatgtcacgaatcaggcaatgctctcgccagattttctgaataaactgcctgcgctgaatcgcaccggtaagatgttgcacagcctgttcaaccattatcgcagcggtagtatgcgcactggcgtccggatgcacgatctctgtgcgatcgcctggctggtgcgtccggagctttttaccctgcaatcctgttttgtggccgtagaaacgcagggggaatataccgcaggcacgacggtcgttgatattgaagggcgtctggggcagcccgccaacgcgcaggtggcgctggcgctggatgtggacggttttcgtcagtgggtggctgaggtgtttgcctatgtgccgtaattacatgttggcgccataatctcatactttgccgcgatagagtctctccggcctgcccactttcccgtagctgatctccgcttcgagaaagttatttttcacgccttgttccagatagcgtcgggcagtggttttactgctgcccagaatttgcgccagagtgtctgctgtatgtactgcctgcgggtcggcgaatatttgtcgtacccggttgaaggtgttttcatcaattccccgcagtccgctattcggttctgcggtttgttctttggcctggatattaaataaggcatcaacgtgcgtctggtttgcctgctcactggaacgtaacgaactgcggtaacgggtgaaccgctccagggtatgctgcaggcgctgataatgtaccggcttaatcagataatcgaatacgcccatgcgtaaggcatcgctgatggtatccatatgattgtcggcggtaatgaaaataattcgccccgtgtagttggtgctgatggtatgacgaattaaatcgatccctttgccatcgggtaaaaaattatccaatagaattaactgtggttgatagaggcgtatttgcttcttcgcactttccagcttgtctgcgataccgacgattgaaaactgaggaaaaagcttgatggtgtccaccaggatttccgctagcatcggttcgtcttcaacgatgagtgtcgtaatgctatccatgttattcttctctggtaaaagggatatagagggtaaaaatggtgccaaaagaattattgttatcgacgataatgtcgccattggcctgcttgacgtagctgtgcaccaaccataatccaattccgtgatcgccgttgttgtgggtggtcactccacgctcgaaaatatgctggcggatattttcgtcaataccacatccctgatcggcaacttcaataatgacttcattaccttcgctattgatcaggcactcaatctgtcgcgagccttcgcgattgagcagggtggcgttataggcgttgtccaataaattgccaacaatcgaaatccattcattatgcgagagcgatgacggcaggtgttcaacaaagcttgaaggatcgaaaatcagctccagccccagctcttttgcccgataatatttaccgattaatagccccgcaaggtggtggtcgcggaaattatgggaaataaaatcgagtactttttggtggctttccgactgctgctgaatcagcgccagcgcattatcgtagcgcttcaggaacagcagtccggcaatggtggaaataaggttgcgatgctcatgctgcacggcgcgcaggttatcggcgtattgccgcacctgacttaactgcaggttgagtgtattgatatcgtctttgttgcgaaagctaataacccagccctgaggctggttgtcaataatgaccgccatgcgactggcgatgactttcatttggttaaaagtgacgatctcatcttttttgtttttttgcggcgcatcgtaaaagaaggcctccggcaacacgatatggtggattgcatagccaatgagttcagactccggttggctcagattcagtaagcggcgagccgtttgattaatggcggtaatacggtgatgggagtcaatggcgatcaacccttcaaataccgactcaaataacacgctttgctgaattaatagttgtgaaagctgctgcggctccatgttaagcatctgctttttaatatgcagcgagaagcggcgggcgcagtacaacagcaccagcaacagtatcgccatcgggaacagcaacgagctgatttgtaagttaagccagctctccaactgttccagagtatagccgacggaaacaataccgatgactttaccggtactgtcctgaatcggggatttaccacgcaaggaagagcctaatgaacctttgcgcaccgatacgtagcttttagcattatacagcgcgtcgtcgctatcgccgccctccatatatttgccgatctcatccgggttgacgtgatacagtcgctgacctttttcgttgccaacggtaatgtaagtcgcgtccgaaaacgagcgcattgggtcaatcagcgctttgatgcgtgacaaatcatgcgcctctacggcttcaactaattctggcatagcggatatttgcattgcttgaataagcgcacgttggcccacctgataatgcaggcgctctttcgtgatatcggtcagataccaggtgattgccagcatcacgatggtggatgtaaacaggatcagtagaaatatccggttttgaaacgagcgtctggcaaaccagtgtgtaatttcccgtataaacatattggtatttagatatttaattacggtattttcttgcattcggcatcaccggaacctgaaccagttcatacttacttttctttcagaaaaaatttggatgaaaatgggatacgacatgcgtatcccatccactattacatcgccagcacgtatttcagcatcaccccggcggctatcgccgagccaatcaccccggccacgttcgggcccatcgcgtgcatcagcaggaagttctgcgcgtctgattccaggcccactttgttcgatacgcgtgccgccatcggcactgccgacaccccggctgaacctatcagcgggttgattttgttcttactgcacaggttcagcagcttcgccatcagcaccccggccgccgtcccgataccaaaggcaatcacccccagcagcagaatgcccagcgtctgcggctgcaggaacttatccgcgaccagcttcgcgcccaccgacagcccgaggaaaatggtcacgatattaatcagaccgttctgcaccgtgtcgctcagacgctccaccaccccgctttcacgcatcagattgccgaagcagaacatccccagcagcggcgcggcgtccggcagcagcagggccaccagcagtaacagcaccaccggaaagaggattttttcccgcttactcaccgtgcgcagctgcaccatgcggattttgcgctctttctcgctggtcagcgcgcgcataatcggcggctggattaacggcaccagcgccatatacgagtaggccgccaccgcaatggcccccagcagctccggtgccagcttgcccgacagataaatcgccgtcgggccgtccgcgccgccgataatgccgatggccgccgcctgcggcagggtgaaggcaatcaggccgaagtagttcagcgtcagcgcccccagtacggtggcgaagatgccgaactgtgccgccgcccccagcagcagggtgcgcggattggccagcagcgggccgaagtcggtcatcgcgccgacgcccataaagatgaccagcggcgcgacgccggagccaatcgccactttatagaacagcgccagcacccccggcgtgtagcccatgtccaccgccagattttccatctggttctggactgacggcagggccagcgccagcgcttccttgatggcgtgcacgtccggcgcgcagttgagcttcgcggcaatcaccgccagctgcccggcgtcgtgatgggccagcaggctctccagcgcggtcagcgccatgcccgcttccgggatgttggagagcaggccgccgaagcctatcggcagcagcagtaacggttcgaactttttcgctatcgccagccacagcaacagcaggctgaccagcagcatgatggcctggcccgcgccaaggtgcatcagccccatgccctgaagcagggcgttcagactttccatttcagttctccgttacgccagcgtcatcagggtgtcgcccacggagacggcgtccccggacttcaccgcgataccgcggacggtgccggcctgcgcggcgcggatttcggtttccatcttcatggcttccagaatcagcagcacgtcgccttcggccacgctctggccttcggtggcaatcaccttccagatgttgcccgccagcggcgcggtgaccggggtgccggcgcctgccggggcggcagcctgaaccggtgcggaagaggccgccggaacagccgtagtaagctggctgatatcgccgccgtcgctgaccctcaccacaaaggctttgccttccacttccacggtgtagataccggaggcggcaggcttctctgcttttgccaccggctgcgcggcttccgcctgcggcagtggctcaaacgccgccgggttatggcggttctcaaggaatttgaggccgatttgcgggaacagcgccacggtgagcacgtcgtcgatggcgtttcccgccagagtaatccccttctcctgcgcctggcgcctgacgtccgcttccagttcagccagctccggcttcagcaggtccgccgggcggcaggtcaccggagcgctcccttccagcacgcgggcctgtaacgcggcgttaaccggcaccggggtgtggccgtattcgcctttcagaatgccggcggtttccttcgcgatggttttgtagcgttcgccggtcaggacgttgagcaccgcctgggtgccgacaatctgcgaggtcggggtgaccagcgggataaagccgaggtcctcgcgcacgcgggggattttcgccagcacctggtccagcctgtccgccgcgttctgctgcttcagctggctttcgaggttggtcagcatcccgcccggtacctgcgccaccagaatacggctgtcgtagcctttcagctggccttcaaaggcatggtactttttgcgcacctcgcggaagtacgcggcgatattttccagcttcaggatatccagcccggtgtcgtgctcagtacctgccaacgtcgccaccagcgcctcggtggccgggtggccgtaggtggcgctcatggacgaaatcgccgtgtccacgccgtcaacatccgcctcgatagccttcagcagggccatctccgccatcccggtggtggcgtgacagtgcaggtgcaggcgcacctcaaaacgttttttgatttcgctcaccagctcaaaagcggccatcggcgtgagaatgccggacatatccttgatggcaatcgagtcaacgccggtctctaacaactgttcggtcaggtccagccaggtctgcagggtgtgcgccgggctggtggtgtaggagagcgtcccctgggcgtgcgcgccgtggctgcgcaccgcctgcagggcggctttcatattgcgcgggtcgttcatggcatcgaagacgcggaacacatccatgccgtttttcaccgcgcgttcaacgaagcgctccaccacatcatcggcgtagtggcggtagccgagcaggttctggccgcgcagcagcatctgcagcggggttttgggcatggcttttttgagttcgcgcaggcgcagccacgggtcttcgccgagaaaacgaatacaggcgtcaaaggtggcgccgccccagcactccagcgagccgtagcccacgtcgtcgagctgagcggcaatcggcagcatatcgtcaaggcgcaggcgggtggcgaacagagactggtgggcgtcacgcaggacgacgtcggtaatggcaatagtcatggatccctccgggaattaagcgttaaggcggtgatggtgaatggcggcggcaatcaccggctttaagcgggtgaagtcgtccacggcgggaacggcgcgcggtgcgggcgcggcgacgggttccgggaagaagcgagtaatcacggcagacataccgcgaatggcaaagatcagcaggaacagaaagctcagtacgaaccccatccctaaaaacatcagggtgaaaccttcacccagtaatacagcttcattcatgaatcattttccataatgagaggcacgacggtggccttgacgacaaccttcctggtgaatccggctaaggagtagagtggatttcccttggccacctctggctttggcctctacttttctccaggtcgtttgcggcaaagacaccgccgtgcgtttttttacaccatcatgctgaacacgatgctagcgataaccagcacaataccgccgcccagacgagaggaaatttgtgcatatgaaatgaggttcatacggttacaggcggagagcacttccagatcgccggagccgccgcggttggccatacaaagacccgcagtaatggatgattcaatcgggtagaagccaatcaaccagcccccgatagctgcgccaacgacagcgccgaccacaatgatcgcggcgataacgacgttcgcgaacgtcagggcatcgatgatctcttgcagatcggtgtagcaaacacccacacctaccatcagcacccacagcagttgtttggagaagaagtcagaaagacgtttcgccccggctttaatctccggtgagcaaagacctgatgcgttcagcgcagcaacaatcaggaccatccaggcgaagtagtgaatagagacgccgccgatgcttggcagaattttcttggcaacaacataggccagcaggaagcaggtggtggataacaccatgccaaccgccgtttcacgatgggtaatctgaccggccttttcatcatcttcggttttgaaggaagccttacgaaccaattcaccttcaccgctaagccaggtgtattttttgcctatcatatcgaggagggcggcgaaaataatggcgaagatattcgcaatggtcagaatagcaatagccgttgagtaatactcttcgcgagaacgtccggtaaccgagtgataaatttcagacagaggcacggcgcctgcgccgttaccaccgcccataatcggcagaacgtatagcatcatgatacggtcgaccgggataccgaagcacaaaccaatgacgataccgaaaagggacgcgccgacaatcccggcgaggatggttgggatatagcccagcagtgattttaatagcagcttacggtttaccgacaggatcgcgcctgtgatcaacactgcgataaacaggttaaggaagttgcttttatccattacgttgctgatcgcatcaatttctttctgcgtaaatatgccagcatagacaaaataagctgcaaccagaaatatcataaccggtgcgccgccaatatatttattgaagatcggtaaacgtttgccgatttcaccaaaaatggcccccataacaaacataagagcaaaaccaccgactaagtcagtcggtatagcattatagaaatgagacagtaataaagtaattaatgcaaaggcataaagcggtagcggcataccaaagattttgaatctgagtaaatcgctggccccctttttctccgtcgccgaagcctgggtcatgttggtcataaacattttcctgtgtattgatgggtaacaagacccgcgcatactaataaattcaatgaaccgtgagatgtgactatcttcactgaatggttgtgtttttaattaatttaattatttttattaactctggttaattaaggaaataaaaaccataaagcttataaaagcaagggggaaagtgtgatgtctattccagacgagtaatacaaacgctggcgaaatatgcaacgttatttgctgacggatgcagaatagagtgaatctaatatttaaacgcatttatttgcaaaaggatgtattgcgtcgcgagtcggtcgccatgtttctggagggcgtgggactcgccctggaagatgattgtgaaatcgcggtatgcgcatattggcagggtgagatagttggatgcggctcgctggccggaaacgtactgaaatgcatcgccgtttccccggttttacaaggggaagggctcagcctcaaactgctgactgagctgcttacattggcctacgagttaaaccgcagcgagcttttcctgttcactaagccgcaaaatcggttgctgttttctggcgcggggttttggcccattgcgcaggcaggtgagctggcggtgttaatggagaacagcagtgaacggttagcgcgcttttgtcgccaactggcgctttatcgtcaaccgggaaaaacgatcggcgccattgtcatgaacgccaatccgtttaccttgggccaccgttatctggtggagcaagcggctgcggcctgtgactggttgcatctgtttgtagtcaaagaagatgcttcatttttttcctataccgaccgttgggcgctgatcgaacaaggaatcgcgggcattgacaacgtcacgttgcattccggctccgcttatatgatctcgcgtgcgacgtttcccggctatttcctcaaagaaaaaggggttgtggacgactgccattgccagatcgatctgcaactcttccgtgaacatctggctccagcgctggggattacccatcgttttgtcggcagtgagccgttttgtcctctgacctgtgcctataaccagcggatgcacgacattttacacgatccgaagcgcagcggcccggttattgaggtcgtcgagctggcgcgggtggagaaaaacggcacggctatttccgcctctcgcgtcagaaaactgtatagcgaacgtaattggccggcaataagcgcgctggtgcctgctggcaccctggcatatctgcagcggcatgccgccagacacactgaaaccatatgacgtaacaccgttaacaaggaacataactaatgaaaatcattaaagatgccctggcaggcacgctggaatccagcgatgtgatgatcaggattggtccatccagcgagccaggaattcggctggagctagagagtctggtgaagcagcagtttggcgcggcgattgagcaggtggttcgggaaacgctggcgaagctgggcgttgaacgcgcgctggttagcgtcgatgacaaaggcgcgctggagtgtattttacgcgcccgagtgcaggcggcggcgttacgcgctgcagaacaaacggaaattcaatggagtgcgttatgagacctcgtcgcagtatgttgtttatccccggcgcaaatgcggccatgttgagcacctcgtttgtctatggtgcggacgcggtgatgttcgacttagaagacgccgtagcattacgtgagaaagataccgcccgtcttttagtccatcacgcgcttcaacatccgttctatcaggatgttgaaaaagtggtgcgcattaatccactgaacacgccattcggtctggccgatcttgaggccgtcgtgcgtggtggcgcggatatcgtgcgtctgccgaaaaccgacagcaaaaacgatgtgctggagctggaagcgcaggttgaacggatcgaacgtgaatgtggacgtgaagtcggcagtaccaggctgatggcggcgatcgaatcagcgaaaggcgtggtcaatgccgtcgacatcgccacctccagcccgcgcatggtggcaattgcgctggcggcatttgattacgtgatggatatgggcaccagccggggcgatggcaccgagctgttctacgcccgctgcgcagtgctgcatgcggcgcgcgttgcgggtattgccgcctatgatgtcgtttggtcggatatcaataatgaagaaggcttcctgaaggaagtgcagttggcgaaagggcttggttttaacggtaagtccttagtgaatccacgtcagattgagctgttacatcaggcttattctccgacgcgtaaagaagttgagcatgcgcacgaggtgattgccgccgctgaagaggctgagtctcgcggtctgggcgtcgtttcactcaacggcaaaatgattgacggcccgattatcgaccacgcgcgcaaagtggtggcgctgtcggcttccggtattcgtgattaaggaaggaaccatgaaagagactgtaactatgctcaatcagcaatatgtcgtaccggaaggattacaaccctaccagggggtaacagtgaatagcccgtggcttgccagtgaaacggaaaagcgtcggcgtaaaatttgtgactcgcttgaagaggctatccgtcgttccgggcttaaaaatggcatgacgatatccttccaccatgcgtttcgtggtggcgacaaagttgtcaatatggtgatggcgaaactggcggaaatgggattccgcgatctgacgcttgcctccagctcgttaatcgatgcccactggccgcttatcgaacacattaaaaatggcgtggtgcggcagatttacacctctgggctgcgcggcaagttaggggaagagatctccgctggcctgatggaaaacccggtacagatccactctcacggcggccgcgtaaaactgattcagagcggtgagctgaatattgatgtcgctttcctcggcgtgccgtgctgcgacgaatttggtaatgcgaacggttttagcggcaagtcacgctgcggctctttggggtatgcgcaggttgatgcgcagtacgctaaatgtgtggtgctcctgactgaagagtgggtcgagttccccaattatccggccagtatcgcgcaggatcaggttgatttgatcgtacaggtggacgaagtaggggatccggaaaaaatcactgcgggcgcgattcgtctgtccagcaacccgcgtgaactgttgatcgcccggcaggcggccaatgtgatcgaacactcgggttatttttgtgacggtttctcgctgcaaaccggcaccggtggcgcttctctggcggtcacccgtttcctggaagacaaaatgcgtcgccacaacattacggcgagttttggcctgggcgggatcaccggcaccatggtggatctgcatgagaaagggttgatcaaagcgctgctggatacgcaatcattcgatggcgatgcagcccgttcgctggcgcagaacccgcatcatattgaaatttcaaccaatcaatacgcgaaccccggctctaaaggcgcggcatgcgaacgcctgaatgtggtgatgctgagcgcgctggaaattgacgtgaatttcaacgttaacgtgatgaccggttcaaacggcgtactgtgtggcgcatcgggcggccatagcgatacggcagcaggggccgatctcaccattattaccgcaccgctggtgcgcgggcgtattccttgcgtggtagaaaaagtgctgactaccgtcacgctaggggcaagcgttgatgtgctggttaccgaccatggtattgcggtgaaccctgcgcgtcaggatctgcttgataacctgcgtgctgcgggcgtggcgctgatgaccatcgaacaactgcaacagcgcgccgagcaactgaccggtaaaccgcagccgattgagtttaccgatcgggtggtggctgtggtgcgttatcgcgacggttcagtgattgacgtgattcgccaggttaaaggctgatgaagggcacagacctgctgtaccagggccaggcagttacgctggaggagatgctacaagcgcgcgataaacgtgccgccaggcagcgtcaggcgttgaactgctatcggctaccgttgatttccctcacgctggttgcaccgggcgccgttaaaaactcagcggtctggcggcgtgtcgccgattacgcaattgccgaaatactggcgctttgcgaacagaaggagtgggtcaacgtctgggaaatgcaggtaaatgaacgcagcggcccggaatggatggcagcggtctgtgcgccggcaatggcgttgaaacagcacatgtcgacactagagatgagccatccgttagggcggctttgggacatcgacattattgatagcgacggtaagtcgctatcacgccgtgaactcgggcatcctgcccggccatgtttgatatgccagcaggatgctcatctctgtgcccggggcaagcatcacacccttgaccttttgttggatgaaattgcacgaaggattgaatgctatgaacgtgagcgttgtgactgaacggcgtacgccagcgtactcatcgctggcggctggcgaacttaatgggttggttgcaagagcgctgctgacggaagccaggctgacaccaaaacccggtctggtcgatattcgtaattcgggagcgcatagggatatggatctggcggcatttgaacgtagcactaccgccattgctccgtggatggaaaagttttttatcatgggcaacaacacggcggcgctggcggcagaaaatgtcctggtgatgctgcgtccgctggggatggcctgtgagaacgatatgctacaggcgaccaatggtgtgaatacccatcgcggggcgattttcgcttttggcctgctgagcgcagcgattggccgacttctcgcgcggggagaaccgttggagcaaaatcgtatctgcgaccaggttgctcgcctgagtcggaatattgttgcccacgagctctcagcaagaaaagcgggaaaactgacaaagagtgaaacccatttccagtgttatggcctgtcgggcgcgcggggagaagcggaaagcggttttcgaaccgtcagaacgcaggctttgccggtgtttaaccgggtcgtgcaggagcatgacgatacccatcttgccctgctgcaaacattgttgcatctgatggcgtggaatgatgataccaatctggtgtcacggggaggcctggaagggctttactacgtgcagcagcaggcacaaaaattgttgtggcaagggggcgtattggttgaggggggcattgaagcgatgcagttcctcgatgatgaactcatcctgcgtaacttaagccctggcggtagcgcggatttactggcagtgacctggtttttaagtcattttcctgccggttccctctatcctgagtaagtttctcttctttcattctctccagcaatgattcatcctgtgggatgaatcatgtcttttactgatatcgctccctgtttatcattaatttctaattatcggcgattttagatggcggcctccgggcgcgctggttactctgaaaacggtttacgcaatttttacaaaagagaatagctatgcatgaagcacaaatccgcgtcgccattgccggcgccggtggccgcatgggacggcagttaatccaggccgccatggcgatggaaggtgttcagctgggtgccgcgctggagcgcgaaggctcttccttgctgggcagcgatgctggcgaactggcgggggcgggaaagtccggcgtgatcgttcaaagcagccttgaggcggtaaaagatgattttgacgttttcatcgattttacccgtccggaaggcacgttgacgcatctggcgttttgccgccagcatggtaaagggatggtgattggtactaccggctttgacgacgccggtaaacaggccattcgtgaggcgtcgcaagagattgcgatcgttttcgccgcaaactttagcgtcggcgttaacgtcatgctcaagctgctggagaaagccgcgaaggtaatgggcgactatagcgatattgaaattattgaagcgcaccaccgccataaagtggatgcaccgtcggggacagcgctggcaatgggcgaggcaatcgccggggcgctggataaagatctgaaggactgcgcggtctactcgcgtgaaggttataccggcgagcgcgtaccgggaacgattggctttgcaaccgttcgggcgggcgacatcgtcggcgaacataccgcgatgtttgccgatattggcgagcgcgtagagattacgcataaagcttccagccgcatgacgtttgcaaatggcgcgttgcgatcggcgttatggctaaaaacgaagaaaaatgggctatttgacatgcgggatgtgctggggctggatgtattatagcgactaaataccttcgtgatgtggttgtggtaatcaagattaattgattacaaagggcaatatattattgcccttttgtttttgcccctcggttattcggtcagataaataacgcctttcaccattcatgtttcgacagtttcttctcccacgacatgttctgccgcagtggcttaccgtatgcaaaaggcacctcgaccagactgataagactgatatccattggggggttagtgctgttccacgggatcgttttatctcttttgcttcaataagttagcttttttatgctgtagtgaggctgtttgtggtccaatcgtatgcgcctgtcttaaagaaaaagaagttagatattaatatcgaaattggagttatcattatatagtcttaatttgctgttttttgttgattttatgatgcatttgatttgttttttatatttttaaggtattgatttttaaaatgtttttgttgttaatttgatttattttgaatttttatgcatttaatgactattaaatgaatttttatcgttgttttttgttgttttaatgtgaaatttgaccatttggtccactttttatcatggcagccagttttttgcgaactcaaggaagcgcaagcgttttctatcgtcacttagttgatctttttgcctattaaacagaataacttccttataatgtgcaaaataacataaaaaatacccgctttaagttgacttttatccggcttaacttcagaatgccgccgtttgccagaaatccacgggtaagcaaatttgcattgcttcatactgactgaatgaattgatatgcaaataaagtgagtgaatattctctggagggtgttttgattaagtcagcgctattggttctggaagacggaacccagtttcacggtcgggccataggggcaacaggttcggcggttggggaagtcgttttcaatacttcaatgaccggttatcaagaaatcctcactgatccttcctattcccgccaaatcgtcactcttacttatccccatattggtaatgtcggcaccaatgaagccgatgaagaatcttctcaggttcatgcgcaaggtttagtgattcgcgatctgccgttgattgccagcaacttccgtaacaccgaagacctctcttcttacctgaaacgccataacatcgtggcgattgccgatatcgatacccgcaagctgacccgactgctgcgtgagaaaggcgcacagaacggctgcatcattgcaggcgatagcccggatgcgaagctggcgctggaaaaagcgaaagcatttcctggactgaacggtatggatctggcgaaagaagtgaccacggcggaaacttaccgctggacgcagggtagctggacgctgaaagacggtttaccggaagcgaaatctgaggatgacctgccgttccacgtggtggcctacgattttggcgccaagcgcaacattctacgtatgctggtggatcgcggctgccgcctgacggtggtgccagcgcaaacctctgctgaagaggtgctgaaaatgaatccggacggcatcttcctgtcgaacggccctggcgacccggcgccgtgcgactacgccatcgaggcgattaagaaattcctccagaccgacattcctgtgttcggcatctgcctcggccatcaactgctggcgctggcgagcggtgcgaagaccgttaagatgaagttcggccatcacggcggcaaccatccggtaaaagatatggacagaaacgtggtgatgatcaccgcgcagaaccacggatttgcggtggatgaagactcgctgcccgccaacctgcgcgtgacccacaagtcgctgttcgacggcaccctgcagggcattcaccgtaccgacaaaccggcgttcagcttccagggacacccggaggcgagcccgggcccgcacgatgcggcgccgctgttcgaccactttatcgaattgattaagcactaccgttcttcagcaaaataatcaggagccaacaaaatgccaaaacgtacagatataaaaagcatcctgattctgggcgcgggcccgattgttatcggtcaggcgtgtgagtttgactactccggcgctcaggcgtgtaaagcgctgcgcgaagaaggctaccgcgttattctggtgaactctaacccggccaccatcatgaccgacccggaaatggccgatgccacctacatcgagccgattcactgggaagtggtgcgcaaaatcatcgaaaaagagcgtccggatgcggtgctgccgaccatgggcggccagaccgcgctgaactgcgcgctggagttggagcggcagggcgtgctcgaagagttcggcgtcaccatgattggcgccaccgccgacgccattgataaagccgaagaccgtcgtcgcttcgatatcgccatgaagaaaattggtctcgacaccgcgcgttccggtatcgcgcacaccatggaagaagcgctggcggttgccgctgacgtgggcttcccgtgcatcatccggcctagctttaccatgggcggcaccggcggcggtatcgcttacaaccgtgaagagttcgaagaaatctgcgaacgcggtctggatctctcgccaaccaacgaattgctgattgatgaatcgctgatcggctggaaagagtacgagatggaagtggtgcgtgataaaaacgacaactgcatcatcgtctgctctatcgaaaatttcgatgcgatgggtatccatactggggactcgatcaccgtggcgcccgcccagactctgaccgacaaagaatatcaaatcatgcgtaacgcctcgatggcggtactgcgtgaaatcggcgtcgaaaccggcggttctaacgtccagttcgcagtgaacccgaaaaacggtcgtctgatcgttatcgaaatgaacccgcgcgtctcccgctcctcggcgctggcgtcgaaagccaccggtttcccgattgccaaagtggccgccaaactggcggtaggttacacccttgacgaactgatgaacgacatcaccggcgggcgtactccggcctccttcgagccgtccatcgactacgttgtgaccaaaattccgcgctttaacttcgagaaattcgccggtgccaacgaccgtctgaccacccagatgaaatcggtcggagaagtgatggcgattggccgcacgcagcaggaatccctgcaaaaagcgctgcgcggcctggaagtcggcgccaccggcttcgacccgaaagtcagcctcgacgacccggaagcgctgaccaaaatccgccgcgagctgaaagatgcgggcgcagatcgtatctggtatatcgccgatgccttccgcgcaggcctctccgtcgacggcgtgttcaacctgaccaacatcgaccgctggttcctggtgcaaattgaagagctggtgcgtctggaagagaaagtaactgaagtcgggattactggcctcaacgccgacttcctgcgtcagctcaagcgtaaaggttttgccgatgcgcgtctggcaaaattggcgggcgtgcgcgagggggaaatccgtaagctgcgcgaccagtatgacctgcacccggtctacaagcgtgtggatacctgcgcggcggaattcgccaccgacaccgcctatatgtactccacttatgaagatgagtgcgaagcgaacccgtccgttgaccgcgataaaatcatggtcctcggcggcggcccgaaccgtatcggccagggcattgagtttgactactgctgcgtacacgcctcgctggcgctgcgcgaagacggttacgagaccatcatggtcaactgtaacccggaaaccgtctctaccgactacgacacttccgaccgcctgtacttcgagccggtgacgctggaagacgtgctggaaatcgtgcgtatcgagaagccgaaaggcgttatcgtgcagtacggcggccagaccccgctaaagctggcgcgcgcgctggaagcggcaggcgtgccggttatcggcaccagcccggacgccatcgaccgcgcggaagaccgcgagcgcttccagcacgcggttgaccgtctgaagctgaagcaaccggccaacgccaccgtcaccgccattgaacaggctgtcgaaaaagcgaaagagatcggctacccgctggtggtgcgtccttcttacgtgctgggcggccgggcgatggaaattgtctatgacgaagccgatctgcgtcgctacttccagacggcggtcagcgtctctaacgatgcgccggtgctgctggatcgcttccttgatgacgcggttgaagtggacgtggacgctatctgcgacggcgaaatggtgctgattggcggtatcatggagcacatcgagcaggcgggcgtacactccggcgactccgcctgttctctgccggcctacacgctaagccaggaaattcaggatgtgatgcgccagcaggtgcagaagctggccttcgagttgcaggtgcgcggcctgatgaacgtgcagtttgcggtgaaagacaacgaagtctacctgattgaagtcaacccgcgtgcggcgcgtactgtgccgttcgtctccaaagccaccggcgtgccgctggcgaaagtggcggcgcgcgtgatggccggcaaatcgctgaccgagcagggcgtgactcaagaaattatcccgccgtactactcggtgaaagaagtggtactgccgttcaacaaattcccgggcgttgacccgctgttagggccagaaatgcgctccaccggggaagtgatgggcgtgggccgtaccttcgcggaagcgttcgccaaggcacagctgggcagtaactccactatgaagaaacagggccgtgcgttgctctcggttcgcgaaggcgacaaagagcgcgtggtggacctggccgctaagctgctgaaacaaggcttcgagctggatgccacccacggtacggcgattgtgctgggcgaagccggtatcaacccgcgtctggtgaacaaggtgcacgaaggtcgtccgcacattcaggaccgcatcaagaatggcgaatatacctacatcatcaacaccaccgcaggccgccgggcgattgaagactcaagggtgattcgccgcagcgcgttgcagtataaggtgcattatgacaccacgctgaacggcggttttgccacgacgatggcgctcaatgccgatgccaccgagaaggtaacctcggtgcaggaaatgcacgcgcagatcaaaaagtcgtaaaccaagggggcggcggatattgctctaaccgaacctgtaatataatgttgaaagggtttctgtaaagaaaccctttttttatcttgcgtaaggtcattcctggagaagtccgtttccgtaaccacattttcaatgtaataagcacgatattgctcacactaatcaatatttaagtcgcatactatctttcatatccacaattttaatatggcttagtttttattagtttggacaggccgtagccagatttttaatttgtgaaatggtgtgcttatgtgtgaaaaatatgttgaaagaccgctttatttgttaattgctgactggatgatggcagagaaccgatggatcactgccagggagatttcccgtcaatttgatattgaacattgcaaagcaattaatacgctctcctatattctgtcagaagtgggggaaattgtttgtgaagtgaagatgatccctaaccaaattgcaggacgaggctgccagtgccagcgtctggtgaaagtcgtgagtatcgactctcaactctatcgccgattgaatcataatttgcaggaaagaaaagtgagcgtggcgaaagcgccgcggctgtctgccgttccccccacagagctaaaccgtgagcagaaatggcagatgatgctctccaagagtatgcgtcgctaattgtctgtttaacctgctggcggggtaaacggtaattgacgcgtaggccggataagcgtgagcgcatccggcatcaattactgtgctgattttggcttcacgtccgtcgtgcctttcaggcgcggtcggttttcttcgacctgcgttaacggcttcgtttcagataaccccgttcgacaacggatcgcaagatcctgatattctttggtattgaggcgtttccagtgcagctcctggtccgtaacctggcgtagtacgcgcgccggtgatcccaccagcagttgccttgcctcaccctgaaatccggctttgacaaaactcatggcggcgacaatgctctcttcgccaatcactgcgccgtccataatgacgctattcatgccgaccagggcatcccgtcccaccacgcagccatgtagaatagcgccgtggccgatatggccgttttcatgcacgatggtatcggtatcgcagtagccatgcataatgcagccatcctgcagattagagcctgcctccaggatcaggcgaccataatccccacgcaatgacgcgagtgggccaatataaacaccggcgcccacgatgacatcgccaatcagcacggcgctgggatggacaaacgcgtccggatgcaccaccgggatcagtccttcaaaggcgtaatagctcatggttgtacctcggtttttttttgtcggatggcggcgtaaataccttatccggcctacggttgtgcatgtgttgtaggccggataagcaaagcgccatccggcatagtcacattaacgacctttccacaccggagcgcgtttttcggcaaatgcctgcggtccttcgagcgcatcttctgaatgcagtaccgacggataatgtttcagcacgccgctgcggatgtagcggtagccttcttcaaccggcatttcactggtcgcgcgataaatctctttcagcgccgcgatagccagcggagcgctattgaccagttgttgcgccagttcgcgcgcgctctccatcagttcgctctggctgacaacgcggttcacgatcccccaacgcagcgcttcttcggcgctcattcgtctgccggtcattaccatttcgttgacgatagccggtggcagcagcttaggcagacgcaatacgccgccgctgtcaggcacgatgccgagcttggcttccggcagcgcgaagctggcgttttcggcgcagacaataaagtctgccgccagcgccagctcaaaaccgccaccaaatgcgtagccgttcaccgcggcgataaccggcttatcgaggtcaaatatttcggttaaaccggcaaagccgccgggaccaaaatcggcatccggcgcttcaccttccgctgccgcttttaagtcccagcccgcagaaaagaatttctccccgccgccggtaatgattgctacgcgtaattccgggtcgtcacggaaattaagaaaagcttcacccatcgcaaaactggttttcgcatcaatggcattcgctttaggtcggtcgagggtaatttccaggatcgggccgttacgggtcagatgtaatgactcactcatagttcatctccagataaatagtttcccggcgggagggattcctgccggaaggtttatttcagattttttttgattatttttcctgaacagttgcgtggcaggtcagttctgatctccataaaagagggaactttgaatttcgccatattgttttcgcagaagctgaaaaactcggcctcgcttaatgtttcaccttcattaaggacgataaacgctttaatggcttcatcacggatcgcgtctttaataccgaccaccacaatgtcctgaattttcggatgcgcagaaataatattttccagctcgacgcaggagacattttccccgccgcgtttaatcatgttgcagcgtctgtcgacaaaatagaaatagccatcctcatcctggtaacccgaatcaccggtatgtaaccagccctctggttccagcgccctggcggttgcctccggctgcatgtaatactctttgaagatagtcttgccggggatgcctttaatacagatttcgccaatttctccggcgggcagcgggcgattttgatcgtcgcgaatttcagcttcatagctaaagcccacgcgaccaatggaaggccagcgtcgtttgtctccgggacggtcgccaataattccgacaatggtttcagtcataccataagaggtcagcagcctgacgccaaagcgttcggtaaaggcgtctttttcctgcgcggataaattgagatagaacatcacttcgcgcagatgatgctgcctgtccgttggcgtggcgggctggaccatcagcgtgcggatcatcatcgggatgcactcggtcaccgtcgcctgatatttacgtacctgatcccagaaggccctggcgctgtacttctccaggagcacaaaggtgctgccggcggaaaaggctggcattgcggcggtacactggcagtcgatatgaaaagcgggcatcaccgtcatgtacacgtcatcatcgcgcagggcgatttgccaggcagagtaatagcctgcaaagcgcaggttatagtgggtaatcaccaccccttttggacgcgaggtggtaccggaggtaaacagaatttccgccgtatcgtcagtggataacgcgggcgtatagcacagcgtggccgactggcgtgcttgtagttgggaaaagtggctcacgccgtcgtcagccggaagctgctcgccaatcagacagatatgattaagcggagtgctattgtcctggcgtatttcacggtacataggataaaactgggcgctggtaaccagcagactcacctggctgttttgcaggatccaggcgctttcttcgcccagtaagcgggcattaatcggcaccataatggcgccgatttttgccagtccaaaccagcaaaagatgaattccggacagttatccagatgcagcgcgaccctatcacccttgcggatccctaagtaataaaaaaggttcgccgtgcggttaatctcttcattgagcgaagcatagctaaactgccgaacgattccctcacaggattcgaaaattaacgccgttttatctccgtacatcccggccaggtcgtcccacatctgacgtaagttttgtccgccaacgatatccatattgctttatccactgaaatcaggcgtgagcgctaaccggaaaaccgagtagcgcatcgcgtttaatcctcaactttggccaggcctttgccgaccagttccttaatatctgcttcgctataaccaatgtttttcagaatggcggcggtatccatgccgtgtgatggcatgccacgccagattttccccgggttgtttttaaatttcggcatgatgttcggccctttacaggtgcgaccgtccattgtttgccactgagtaatcgattcgcgggcaacgtactgcgggttaccttccagttccggaatggtgagcaccttcgcacaggcgatattcagctcagcaaaacgcgcctgaacgtcggcgatggtatgtgctgccagccaggcgtccagtttctcttcgacgagcgggccgtaagggcattccacgcgatggatgagctgcgtgccttccggaacttccggcgtaccgagaatgtgcgccaggccaatatctttaaaacactcgttgatttgcgtgatgccgaccaactccatgacgatgtaaccatcggcgcatttatacaggccgcaaccggcgtagtaggggtctttccctttcgtcatacgtggacagatttcgccgccgttgaagtagtccatcatgaaatactgacccatgcgcagcatcacttcgtacatggcgatatcgatgctttcacctttacccgtttcgcgtactttgtgcagggctgccagcgcggctgtcgtcgcggtcatcccggagaagtaatcggcggtatacgggaaggctggcatcggttggtcaacgtcgccgttttggatcagataaccactgaatgcctgcgcgatggtgttatacgccggaagattggtgtactcctcggtaccatactggccgaagccggaaaggtgggcaatgaccagtttcgggttatgttcccacagcacttcatcagtaataccacggcgggcaaaggccgggcctttactggcttcaatgaaaatatcggtggtttccatcagtttcagaaacgcttcccgaccttcatctttgaaaatattcagcgacagggcgtgcaggttgcggcgtgagagctgcgggtagttaggctgtacgcggatggtatcggcccatgcgacgttttcaatccagataacctcggcgccccattcggcgaacatctgtccggcgaacggaccggcgatttcgatccctgaaaaaacaacgcgtaccccagcaagaggaccaaaggttggcattggtaaatgattcatcgtttttctcctggcattttttgcggtatgtaggccggataagcacagcgccatccggcatgattgcctgatggcgacgccccgcgtcttatcaggcctacaagggatcgattagcggtattgcttgagtaccgcacgacccaacgtcaggatctgcatttcgtcagaaccaccagaaacacggtcaacgcgcaggtcacgccagaaacgcgtgatgcggtggttgcccgcgataccaacacctcccagtacctgcatggcggtgtctaccacttcaaacgcggcgttggcgcagaagtatttgcacatggccgcgtcgccggaggtaatagtgccgttatctgctttccacgcggcttccagcagcatatttttcatggagttcagtttgatcgccatatgcgcaaacttctcctgaatcagctggaaacggccaatagcttcaccaaactgcacgcgctgattagcgtaacgcgcagcgtcttcaaaagtgcacattgcggtaccgtagttggtcagcgcgacgaggaagcgttcatggtcaaactcttctttcacgcggttgaagccgttaccttcccgaccgaacatgtctttctcgtccagttcaacgtcgtcaaaggtgatttcacagcagctatccatgcgcagaccgagtttctccagtttgttgaccttgatacccgctttgctcatgtccacaaaccactcggtgtaaaccggtttatccggcgatgcaccgtctctcgccatgaccacgatgtacggggtataggcgctactggtgataaagcacttactgccattgagataaaccttaccatttttgcgtgtataagtggttttcagactaccaacatccgatcccgctcccggttcggtgatagcagagttccacatctgcttaccggtgccccggaacgccatgattttatcaatttgctcctgagtcccttcacgcaggaaagtgttaaaacctcccggcaattggtacaacacgtaagttggcgcgccaagacgtcccagttccatccagacggcggcgacggtaacaaaacccgcttccagaccgccgtgttcttccgggatcagcaggctatcaatacccatatccgccagcgcttttacaaaacgctcagggtagacgctgtcacgatcgcactcggcaaaataagcttcccagttctcactggccatcagttcgcgaataccggcgacaaacagctcctgttcgtcatttaagttgaaatccatctttcagcctcttgatcaattgggttaataagaattacttgtctttccagtgcactttggcgtctttaataaaggacagcgtcaccataatgttgacgaagaacagcgggcatcctccggcgataatcgcggtctgaatcggcttcaacccacccagcgccagcagaacgataccgatgatgccgaccagcaccgaccagccgatgcgtactaacagaggcggctcttcaccatcgcgaacttcgcgacaggtcgacatcgccagggtgtaagagcaggcgttaatcagcgtgacggtggcaataaagcagaggatgaagaagccccacatggtggcggtgctgagcggcaaggctgcccaggtttcgataatggcgcgcgccacgccgtgttgctcaatcagttgcgggatgttgaggatgtttttatccatcagcagcagcgtgttactgccaaggactgtccacaggatccaggtagacgcggtcagacccatcaccatcccgaagcacagttcacgtacggtacgaccacgggaaatacgggccaggaagatactcatctggatggcgtaaataacccaccacgcccagtagaaaacggtccagccctgtgggaagccgcctttaccgatggcgtcggtatagaacagcatccgtggcaggtgcattaacagcatcccgacggagtcggtgaagtagttcatgatgaagctggcgccgctgacgataaacacccagccgagcatcaggaagctcaggtagctacgcacatcgctggcgattctgacccctttttgcaggccgcaggccacgcaaatcgcgttcagaatgatccagcaggtaatgatgatggcatccaattgcagcgtatgcggaataccgaacagccattgcatacactcggtgaccagcggggtagccagaccgaggctggtgcccatcgcgaagatcagcgccaccaggtagaagttatcgacgatggtactgaacaaccctttcgcatgcttttcaccgacgagcggtaccagcgtggagctggggcggatgacatccatcttgcgtacaaagaagaagtaggcgaaggccacggaaaggaagctataggttgcccacggtagcggcccccagtggaacaggctgtacgccaggcctatctctttcgcgcccgtggaattgggttccaggccgaacggcggggtggagatatagtagtagatctcaatagagccccagaacagaaccgcagcggatgtacaggaggcgaacatcatgaaaatccagctggcggtgctaaactccggtttttcgtcacctaatctctttttggcataggggccaaaaaccagccagaaccagctgaagagcatgacgaccatataccattcaaatgcccaaccccagacgttggtgacataactgaataccgcattaataacgacgttagcggcatcaagatctctgactgttagccagcaaagtatcccgacaattattaatagcggaaaaaaaaccttcggttcaattcccgattttctcttttcatttttcataagtgaattccagtgtgaaaacgaaatttatttagcgtgccagttcatgaacgtttgtttatttattattaatgatttgttgataagtttttaacctctgggacgcctcaatgagtaactcataatgggtattcatttcgggtgattctgttatctgtgtcacacttttttgcgttgattattttgtgtttaaattttgattttttctttatttatcaatctgttggttgtggttttttaacttttttaagtatctggcgttcaatattgttgagccagcaaacaatattgaaaattttcatatttggcatatttctttcaatattggtgaggtgcgtaacactattgaaagttacgaatatcaatgtgtgacattttcaatattggtgattaaggttttatttccgaattaaagagcgtgatatctgtatttaacaccgccgatataaatacgtttccttcatgatttctggagatgcaatgaagataattacttgctacaaatgcgtacctgatgagcaggatattgcgattaataatgctgacggaacactcgatttcagcaaagcggatagcaaaatcagccaatatgatctgaatgcaattgaagctgcttgccagttaaaacagcagttgggagacgctcaggttgtcgccatgagcgttggcggcaaagcgctgactaatgcaaaagggcgcaaagatgtcctctctcgtggccctgatgaactgattgtggtcattgacgatcaatttgagcaggcgctgccgcaacacaccgctaccgcgctggccgccgcggcgcaaaaatcaggtttcgatctacttatctgcggcgacggttcttccgatctttatgctcagcaggttggtttgctggtgggcgaagcgctgaacattccggcgattaacggcgtgagtaaaatcctctctcttaccgacagcacattgacggtagaacgcgaactggaagatgaagttgaaacgctgagcatcccgctcccggcggtgatcgcggtttccaccgacattaacaccccacaaatcccttcgatgaaagccattcttggcgcggcgaaaaaaccggttcaggtctggtcgcctgcggatatcgggctgaacagcgtacccgcgtattccacacaacaggttgccgcaccgaagcagcgcgagcgtcagcgtgtggtgattgaaggtgacggtgaagaacaaatcgccgcgtttgtcgagaatctgcgcaaaatcatttaattatcaggggatgttatgaacaaattttccagtgtctgggtattcagcgataccccttctcgtctgcccgaactgatgagtggtgcgcaggctgtaggtgaaaaagttaacgcgttcgtactgaacgaagcggacagcgcgacagcatgtcatttgggcgcggatcatgtctggctgctcagcggcaaaccagaagatcgcatgatcgaagactacgctgctgcgatggctgagactattcgtcagcatagcgagggcggcgcggtgctgctgccgaatacgcgtcggggcaagctgttggcggcaaaactgggctatcgcttgtcggctgcggtttccaacgacgccagcgacgtctccctgcaggatggaaaagcggcggtcaaacatatggtctacggcggtctggcgataggggcagagaccatcgcttcgccgtttgccgtgatcacactcagcagcggaacgtttgacgcacaacagccggatgcttctcgcagcggcgagatgcacaccgtgcagtggcaggctccggccactgccgtgacccgcaccgcaacccaggcgcgtcagagcaacagcgttgacctcgacaaagcgcgtctggtggtcagcgtgggacgcggcatcggcagcaaagagaatatctcgctggccgaagcgctgtgccagaccatcggcgccgagctggcctgttcccgcccggtggcggaaaacgagaagtggatggagcacgagcgctacgtcggtatctccaacctgatgctcaaacctgaactgtatctggcggtggggatctccgggcagatccaacacatggtcggcgccaacggcgcgcagacgattttcgccatcaacaaagataaaaacgcgccaatcttccagtatgcggattttggcatcgttggcgatgcgctgaagatcctgcctgcgctgacggctgccttagcgcgataaaccatttcgggcaggatacgaaggtatcctgccgctgacaggagtacgtatgtccgaagatatctttgatgccatcatcgtgggtgcaggtctggccggttcggttgcggcgctggtgcttgctcgcgaaggtgcacaggtgctggttatcgagcgcggcaattctgctggcgcgaagaatgtcaccggtgggcgtttgtatgcacatagcctggaacgcatcattcccggctttgcggatcaggcccccattgaacgcatgatcacccacgaaaaactcgcctttatgaccgacaacggggcgatgactatcgactactgcaatggtgaagatgcttcagcgtcgcaggtttcttattccgttttgcgtagtaaatttgacgcctggctgatggagcaggccgaagaggcgggggcgcaactgatcactggtattcgcgtggataacgttgttcagcgtgatggcaaagtcgtgggcgtggaagccgatggcgatattctggaagccaaagtcgtaatcctcgctgacggggtgaattctctgctggctgaaaagctgggcatggccaagcgtgttgaggcatcgcatgttgccgtcggtgtgaaggaactgatcgaattgccgaagtcggtcattgaagatcgtttccagctacagggcaacgaaggtgccgcctgtctgtttgccggggcgccaaccgatggtctgatgggcggtggcttcctgtatacgaatgaaacaaccctttccctagggctggtctgcggtcttcatcatctgaaagacgcgaaaaaatcggtcccgcaaatgctggaagatttcaaacagcatccggccgttgcgccgctgatcgccggtggcaagctggtggaatatgccgcacacgttgtacccgaggcgggaatgaatatgcagcctgaactggtgggcgatggtgtactgattgccggagacgctgccggcatgtgtatgaacctcggctttaccatccggggtatggatctcgccatatccgcaggcgaagcggcggcgaagacggtgctttcggcgatgaagcgcgacgattttagcaagcagtcgttgggtgaataccgtcagcatctggacgaaggtccgatgcgcgatatgcgcatgtatcagaaactgccagcttttcttgataatccccgcatgtttaccgcctatcccgaaatggcggtcagtatcgcgcgcgacctgttcaccgtggatggctccgcgccggtgcccatgcgtaaaaaaatcctgcgccatgcgaagaaagtgggcttcatcaacctgatgaaagatggcctgaaaggagtgaccgtattatgacatctcccgtcaatgtggacgtcaaattgggcgtcaataagttcaatgtggatgaagatagcccgcacatcattctcaaaaccgatcctgataaacaggcgctggaggtgctggttaaggcctgtccggcgggactgtataaaaagcaggacgacggtagcgttcgttttgattacgccgggtgcctggagtgcggaacatgccggatcctcggccttgatacggcgctggaaaaatgggaatacccacgcgggacgtttggcgtggagttccgctacggctaataagtacgagtttgtgcccccgtaggccggattagatgcggtagcgtcgccatccggcaatcatgtggcgccaatgccggatggcggcgtaaacgccttatccggcctacagatgacgctttgcccgtgttgaaacaggacatcaccatgccgcagcccaggaactttgacgaccttaaattctcctccatccatcgcagaattatgctgtggggaagcggcggcccgttccttgatggctacgtgctggtgatcattggcgtggcgctggaacaactgacgccgctattgcaccttgatgctgaatggattggcgcgctcggcgcggctacgcttgccggactgtttatcggcacctcgttgtttggctatatttgcgataaagtcgggcggcgtaaaatgttcctgcttgatattatcgctatcggcgttatctccgtggcgaccatgtttgtttccacgccgcttgaattgctggtgatgcgcgttttaattggcattgttatcggcgcggattaccctatcgccacttccatgattacggagttttccaacacccgccagcgtgcgttctccatcggttttatcgccgcgatgtggtacgtcggcgcgacctgcgccaacctggtgggttactggctgtatgacatggaaggaggctggcgctggatgcttggcagcgcctttatcccgtgcttaatcattttgattggccgctttgacctgccggaatcgccacgctggctattgcgaaaaggacgggtaaaagagtgcgaacaaatgatgatcaaactgttcggcgaaccggtctgctttgacgatgagccgccgcaggagacccgcttcctgcagctgtttaaccgccgtcatttcccgtttgtactgttcgttgcggctatctggagctgtcaggtgatcccgatgttcgctatctatacctttgggccgcagatcgtcgggttactcggctgggaacaggggcgcaacgcggcgctcggcaatgtggtgattagcctcttttttatgctgggctgtataccggcgatgttctggctaaacagtattggccgtcgccctctgcttattggcagcttcgccatgatgactatcgcgctggcgctgctggggctggtgtcaaatctgggtatcatactggtcgtggtggcgtttgcggtatacgccttcttttccggcggaccgggcatactgcaatggctttatcctaatgaactcttccctacggatattcgcgcttcggccgtgggggtcatcatgtcattaagccgtatcggaaccattgtctccacctgggcattaccgatttttattactcgttacggtattaataacgtcatgctgattggcgcgttgatttcgttagtcgggcttggcgtatcggtgatgtttgccccggaaactcgcggcttgacgctaacacagaccggaaacatgactttgcgcggaacgccatcggataaccctcgttaagagtgttctgcatttctccctgcttttcgccaataacgctacagttaacagtcacatgctaaaacaactgaaaagcagggagaacaccatgcaaaaacgtcttatgaccgcactgtttaccgcagcaacactattcaccgtcgcaggatgctcttctaaccaggcggttgaaaccacggatggcaaaactattgtcaccgacgggaaacccgaggtcgataacgataccggtatggtgtcttacaaaaacgccgccaccgggaaaaccgaacagattaaccgcgatcagctgaaaaatatgagcgagctggataattaattcaattttttctggttagccgcgcaataatattctctctttatgcgcatccatttattcccatgcgaataaacggatgcctgaactggcagggacgccggaaaacgtcgaaatacgttcgcccgtgttcccgctttccccaccgcgctgtccgcttacatgaggttacactcatcgacatttctctgaacagcggctcaacatttcccggaaaaaacatatcgcaaggcatttatccttatgattaggtataaatgattaggtataaggaaacggagtctgtaatgaaactgaaactaatacctttttatttgctcgcgctattttctgccgcctccggggctacggagataaacgcctgcaaagacctgatcggaacatggaaaaccactgcagataacccgccttataccatgacaatattgccgccagtagaaggctgcggggaaaaatgtgtgaaactgaacgtacagtatgaacttgacgtgactcaccgcaacgcgctttattgccatgaaggacaagagggggtaaaagggcagggacccatggtgatagcatttgaaggggcgtatggtggacacgctattggaacctataaccgacagctgcaattactttgggctggcgtaataccgaaaaataaaaaggggaaatggataacgaaaatggaaaattactggttcaggcaggtaaaagcgcactaaatattaccttaaaacagcccgcaaaaccgtcttattcacgaagggcttactgcctgcgcgcgcacattccaacggcttgcctgccccggatgaactgttgataaaaaagagggccagcatctgtttccagacggccctgagtggattgtgacgtaacatggcaccttgctggcgctctcttattatttcatgccagtgccatcgttatggcgcaatcagagctttatttcgtcgcatcgttataaacttcggcaacggcttcaaaattcggaccatgctcacgtgcagcgataatatggtaatattttccgcctttcgcatcggctaattctgacagtttttcgcgtagatcagagggtgaggaaatctgcccgccactctgggacacatttatggtgccgaccttaaccagtttgaagtggctgatttcttgcttagagacctgctctgccgcaagtgtgctgaatgaagcaaccgttgccagtaatgcggcggcaatgatgcgttttttcatagttctgttcctgttgcattgatgataaggtttgcgcaatatcagtaatccgtaacgaaattatttatacccttcatacttcaggttgcttatgtgttggctacggattactcggcccacccatgggcctcgccctgacgggccgtcgcacgcgacgttcaaatctgctcccggcagatttgtcgctcacctcagtcacataattatctatgctcctggtgactcactcccttgccgcctttaagcaactcgaattattttgggtaataacctcggttgattatctgaaaatagccttatttggtgtgaccgtcttatatcttgttatagtcacctctttatgttgttgtcaatgtaaaataatgcgctgccagctaaaaagaaacttaaccccctgtaaataatagtttttatattatttcttttaatggcgtaatttttattgaatcacgcgacaatacgctagttttattcataagcaacataacagaattgagttatgttttaatttcccagagtgatattaccggttgtatgtctatggttgcgcggcctgttactgatagtgtttctttcggggcgattttattgtaacggcatagggtaatcaccgtagctgaagggaaaaggcacgaacacagcgctatagagtatgtttaataatgtatttttttatgaagtaatgtctgcagttgtatctctaaaataaaaacaatgaacttttcatctaaataatttttcagtgaattatggttatttattaatatatttctaatttgaaatacaaatcaatttataacacatattcttacccggaaggcattgatacatatccacgcttcctcgtacagtaataaatgaatatgtgataaagttactgactacaggtataataatatgagtaataaaaaaaatctgtccgcagaagagacggatcttacgcgtaggaaactgttaaccagcgccggtattcttgccgccggcggtatgctatccggcgcggtaaaggctgatgaaaaatgcgccgtcaaggcgaaaccgacgtgggataaaccgtttactggcgaaatcccggaaaaattgccagaaggatataatattctgttagtcgtgaccgactaggagcgtttttttcctacgtttcctttccctgtacccggcagagagcggctcatgaaaacgggggtgacattctgtaatcatcagaataccagtaatgtctgtacgccttcccgctccgtattgtataccggcttacatatgccccagacaaagatgtttgataatctgggattaccctggatgccttatgaccttgaccccgctcttggaaccacaggccatatgatgcgggaactgggatactatacggcctataaaggtaagtggcatcttacagaaaaactggagaagcctttgcctgacgaaaaagatgaggatattgatgtcggggatattcctgaaccagaattacataaaattatggaaaaatatggttttgctgactatcacggcatcggcgatattataggccatagtaaaggcggctatttttatgattcaaccaccacggctcagactataaattggttaagatgcaaggggcagcccttgaatgaccaacacaagccctggttcctggccgttaacctcgttaatcctcatgacgtcatgtttattgataccgataaagaaggagaaaaggtacagtggcgtggcgagttggatcaggatgataataccctggcgcccacgcagccgccggaaaacgagctttatcaggcaagctggccgaactatccgctgccggcaaacaggcatcaatcattcaatgagcagggaagaccgccggcgcatcttgaataccagacggcgcgcgctgcgctggaagggcagtttcctgatgaagatcgtcgttggcgtaaactgcttgactactatttcaactgtatccgcgattgtgatactcaccttgaccggatattaaatgaactggatgccctcaagttaactgataaaacgattgttgtatttactgccgatcatggcgaattaggcggaagccatcagatgcacggtaaaggcgcttccgtttataaagaacagatccatgtaccgatgattatttcccacccggcgtaccccggtaataagaaatgtcaggcgttgacctgtcatcttgatattgcgccgacattagttgggctgaccggtttgccggaagaaaaacagcaccaggcgttaggcaaccgcaaaggcgttaattttagcggattgctaaaaaacccggagagcgttgcggttaatgcggtgagaaatgccagcttatattgctatggcatgatcttgtataccgatgcccattatctccaccgtgttatcgcgctacaaagagataaacaaaaacggtggcgcaaatcaagcaggaaatatcgcatttgcatcctgatttcagccatcgttcagggacgcggatgattaacgatggccgttataagtttgcacgctatttctcgctaagggagcataatacgccggaaacctgggaggatcttattaagtacaacgatcttgaactttacgatcttaaaaatgatcctgatgagaaccataaccttgctgctgataaacagaaatatcaggatctcattcttacgatgaatgaaaaactgaataaaattatcaaagacgaaattggcgtggatgacggcagttttatgccggatgcggcccgtgagccatgggatcttactattgagcaatttaaccgcatggcgaaagattaagagcctgacccattaggttaatttatgcgtcggtgatctagcatccagcgtgtctggaggttcagatgctgttggcgctgcgcttattgggcctgtgtcatcatgtaatggattgatattacagtcattacaggaaaatttagcgcagcgccacccgacaagaaggccttaaaccgatttgtcagcaatttaaggctgccatcatcaccaacctttccacaccggatcgcgcttttccacaaacgcctgcggcccttcgagggcatcttccgggggcaggatggcgtcaactccttgctggcgttaattcaattttttctgattagccgctcaataatattcactattagcctggcgaatttgtcactacactttgtgataaaaaacagatcatcacaggctaatcatgatcctcattatttatgcgcatccgtatccgcatcattctcatgcgaataagcagatgcttgaacaggcagggacgctggaaaacgtcgaaatacgttcgctttatcacctctatcccgatttcaatattgacgtagccgccgagcaagaggcgctgtcgcgcgcgagtcttatcgtctggcagcatccgatgcagtggtacagcgtccctcctttactcaaattatggatggataaagtcctcacccacggctgggcttacggtcatggcggtacggcattgcatggtaaacatctgctgtgggcggtaacgaccggcggtggtgaaaaccactttgctatcggctcccatccaggatttgccgtcctttctcagccgctacaggcgacggcgctctattgcggcctcaaatggctgccgccgtttgccatgcactgcacgttcatttgcgatgacgacaccttacaggcgcaggcgcgtcagtataaacagcgtttactggcatggcaggaggtgaatcatggatagccatactctactgcaggcgctgatctatcttggttcagcggcgttgattgtgccgattgcggtacgtttgggcttaggatcagtgctggggtatctgattgcgggttgcattatcggcccctgggggctacggctggtgacggacgccgaatctattctgcattttgcggaaatcggcgtcgtgctgatgttgtttgttattgggcttgaactggacccgcaacggttatggaagctgcgcgcctcggtatttggcggcggcgcgttacagatggtggtctgcggcggactgattggtctgttctgtatgtttcttggcctgcgttggcaggtggcggaactgattggcatgacgctggcgctttcgtccacggctatcgccatgcaggcaatgaatgagcgtaacctgaccgtttcacaggtagggcgtagcgcatttgcagtgctcttgttccaggatatcgcggcgatcccgctggtggcgatgattcctctgctggccgccagcggcgcatccaccacgcttggcgcgtttgcgctatcggcgttgaaagtcgcaggcgcgttggcgctggtggtgttgctgggacgctacgttacgcgcccggcgctgcgctttgtcgcgcgttctggtttgcgggaggtgttcagcgccgtggcgctatttctggtgtttggtttcggcctgttgctggaagaggttgggctgtcaatggcgatgggcgcgttcctggcgggcgttctgctggcgagttcggaatatcgtcatgcgctggaaagcgatattgaaccctttaaggggttgctgctggggttgttctttattggcgtcggcatgtcgattgatttcggcacgctggtggagaatccgctgcgcattctgctgttgttggccggttttctggcaatcaaaatcgtcatgctgtggctggtcgcgaggaccctgggcgtaccggcaaaacagcgtcgctggtttgccgtcttattaggccagggaagtgagtttgcgtttgtggtttttggcgcggcgcaaatggcggatgtacttgagccggaatgggcaaaagcgctgacgctggcggtcgcgctgtcgatggcggccacgccgatttttctggtgctgctgacgcgcatggaaaagaccgcaacgggtgaagcgcgcgaggcggatgaaatcgacgaagagcagccgcgggtcattgtggccgggtttgggcgatttgggcagatagccgggcgtttactgctgtcgagcggggtgaagatggtggtgctcgatcacgaccccgatcatatcgaaacgctgcgtaaattcggcatgaaggttttttatggcgacgcgacgcgtatggatttgctggaatctgccggagcggcgaaggcggaggtattgattaacgccattgacgatccgcaaaccaatttgcaactgagtgaactggtgaagacgcatttcccgcatctgcagattatcgcccgcgcccgtgatgtcgatcattacattcgcctgcgccaggctggtgtggcgatgcccgaacgtgaaaccttcgaaggcgcgctcaaaagcgggcgacaggctttggaggcgctggggctggggcgttatgaagcccgcgagcgcgcggatctgttctgtcattttaatacccggatggtggaagagatggcgaaaggggaaaacgatccgttatctcgcgccgccgcctataaacgtaccagcgcgatgttgagcgaaattattaccgaggaccgggagcatctgtcgttgattcagcgccacggctggcagggaacggctgagggcaaacattccgggaaggccgctgatgaacccgaggtcaaaccgtcaatctaaagtaaaaaatgtgatgttctgcaaactttactgctaattggctgtttttgaactactgtaatgctggcgctccacatcaaatgagtggcgtcgccagcagaacgaaaaattttcgtgctcatcctcttttcgtcagtcgacgaaagattgcgctttacgtatagtggcggcaattttttttgtatcaggaaataattaatgatcagtctgattgcggcgttagcggtggatcgcgtcatcggtatggaaaacgccatgccgtggaacctgcctgccgatctcgcatggtttaaacgtaacacgttaaataaacctgtcgtcatgggacgtcacacctgggagtccatcggacgccccttaccgggacgtaaaaatattattatcagcagccagccgggcaccgacgatcgcgtgcagtgggtgaagtctgtcgatgaggcgattgccgcttgcggcgatgcgccggaaattatggtcattggcggcgggcgcgtgtacgagcagttcctgccaaaggcgcagaagctttatctgacgcatattgatgcggaagtcgaaggcgatacccattttccggattatgaaccggatgactgggaatcggtattcagtgagtttcacgatgccgacgcgcagaattctcacagctattgtttcgagattctggagcgtcgttaacgctgtagtgccggatggcggcgaaatgccttatccggcctactcttgagccggatgtaggcctgataaacgtagcgccatcaggcataaacctatcaggcgttgaccgcttcgccttcgcccatatccatctggcggtttgacggctgcacaaaatactgtttatcttcccaacgtaaacaggttaactccccgccccagcagcagccggtatccagcgcgtaaataccttctggcgtccctttcccttccagcgacgcccagtgcccgaaagcaatactgtaagcctcgctcaccggtcccggaatggcgaaccacggcttcagcggcgcaggggcattttccggcgacgctttgctgtacatatccagttgaccgttaggaaagcagtaacgcatacgggtaaaggcattagtaataaagcgtagccgcgccagaccgcttaactccggcgaccagttattcggcatatcgccatacatcgcgtcgaggaaaaacgggtacgagtcgctcgacagcaccgcttcaacatcgcgggcgcactcttttgccgtctgcaaatcccactgtggggtaatacccgcatgcgccatgaccagctttttctcttcatctacctgcaacagcggctgacggcgtaaccaattcaacagctcatcggcgtccggcgcttcaagaagcggggtcagccggtctttaggtttgttgcggctaatcccggcgaatacggccaacaggtgtaaatcgtgattccccagcaccaaacgcacgctattgccaagcgatttgacgtagcgtaacacgtccagcgaaccgggaccgcgggcgaccaaatcgccagtcagccatagagtgtctgtatctggcgtaaattccacttgctgtaataaggcgatcagttcgtcgtagcaaccgtgaacgtcgccgatgagataagttgccattgttataattttagtgaatgagtgtagggacggcgagtcgaaacacgggaatgtcgatggtaaaggcgtcgccattttcatcgatcatttcgtaatgaccctgcatggtgcccagcggcgtttcaattaccgcgccgccggtgtactgatactcttcgccaggcgcaatgcgcggctggacgccaaccacacctttgccctggacttcagtttcacggccatgaccattggtaatcagccagtagcggcccaatagctgcactggcgcccgacccagattgcggatggttacggtataggcaaaaacgtaacgttcatcgtcaggtgaggattgcgcctcaatgtagacgctttgcacctgaatacacactctgggcgaattgatcatgtttaactctccttcaaaggcgcgttttccgacagatagttggccatctggcagtactgcgcgacagagatattttccgcgcgcattgccgggtcaatacccatttccgtcaacgtctcaacgctaaaaagattgccgagactattacggatcgttttacggcgctggttaaaggcctcggtggtaatacggctcaacacgcgaatatctttaaccgggtaaggcatcgttgcgtgtggaaccagacgcaccacggcggagtccactttgggcggcggcgtgaaggcggatggcggcacttcaagcaccgggatcacctgacagtaatattgcgccatcacgcttaaacgaccatacgctttgctgttcggccctgcaaccagacgatttaccacttctttttgcaacataaagtgcatgtcggcaatggcatcagtatagctaaagagatggaacatcagcggggtggagatattatagggcagattgccgaacacacgcagcggctggcccaactgcgcagacagttcgccaaagttcatggtcatggcgtcctgctgataaatagtcagcttcggccctaaaaacggatgggtttgcaaacgcgccgccagatcgcggtcaagttcaatgaccgtgagcttatccagtcgttcgccgaccggctccgtcagcgccgccagaccggggccgatttcaaccatcgcctggcctttttgcggattaatagcagaaacaatactgtcgatcacaaaccgatcgttgagaaagttttgcccgaagcgtttacgggctaaatggccctgatggactcgattattcattgggtattaacaatcattttgatggcgagattaagcgccgtaataaaactgccgacatccgcttttcctcggcccgccagttcaagcgcggtgccgtgatcaacggaggttcgaataaaaggtaggccgagcgtaatattcactccccgaccgaatccctggtattttagcacgggcaggccctgatcgtggtacattgccagcaccgcgtcggcattatcgagatatttgggctgaaacagcgtatcagcaggtagcggcccgttgagtttcatcccctgcgcccgcagctcgtcgagcaccggaatgatggtgtctatctcttccgtgcccatatgaccgccttcgcccgcgtgcggattcaggccacagacaagaatgcgcggttcggcaataccaaatttggtccgcaaatcgtgatgcaaaatagcaatcacttcgtgcaaaagcgcaggggtgatggcgtctgcaatcgcccgtagcggcagatgcgtggtcgccagcgccacgcgaagttcttcggttgccagcatcatcacgacttttttcgcctgcgaacgctcttcgaaaaactcggtatgaccggtaaacggaatgcctgcgtcgttaataacgcctttgtgcacggggcctgtgatcagcgcggcaaattcaccgttcagacagccatcacacgctcgcgccagcgtctctaccacgtaggggccattttctaccgtcaactgaccggggatggcaggcgcgcgcagcgagaccggcaatagggtcagcgttcccgcgggctgcggcgcagcggggacatcaggcgagtaagggagaagcgagaggggcaggccgagcatggcggcccgctccgtcaggagcgcgccgtccgcacagacgaccagttcaatcggccacgcgcgttgcgccagttggacgacaagatcggggccaatcccggcgggttcgccgggagtgataacaacgcgttgcgcactgctcattagttactcaaaatcttaacgtaagcgctggcgcgctgttcttgcatccaggtcgccgcttcttctgagaatttacggttcatcagcatacgataagcgcgatctttctgcgccgcatcggttttgtctaccttacgcgtatccagcaattcgatcagatgccagccgaaagaggagtgtaccggcgcgcttatttggcctttatgcagcttcgttagcgcgtcgcggaacgccggatcgaaaatatctggcgtagcccaacccaaatcaccgccttggttagcggagcccgggtcctgagagtactctttcgccgctgcggcaaatgtggttttaccactcttaatgtcagccgcgatttcttccagcttcaggcgcgcctgctgatcgttcatgatcggcgacggcttaagcagaatgtgacgagcgtgaacttcggtcacggagatactctggctctgaccgcgcaggtcgtttactttcagaatgtggaagccgacgccggagcgaatcgggccgacaatgtcgcctttcttcgcggtgctcagcgcctgggcgaaaatccccggcagctcctgaatacggccccagcccatctgaccaccttttaacgcctgctggtcggcagagtaggtaatcgccagtttgccgaaatctgcgccgttacgcgcttcttcaacaatgctttccgcctggcgctgcgcgtcgttaacctgctcggaggttgggttttccggcagagcaatcaggatatggctcaggttcagctcggtgctggcgtcgttttgggtgccaatctgttttgccagcgcgtcaacttcttgcggcaaaacggtgatacggcgacgaacttcgttgttgcgcacttcagagataatcatctctttacgaatctggttacggtaggttgaatagttcagcccatcgtaagccagacggctgcgcatctgatccatcgtcatattgttttgtttggcgatgttggcgatggcctgatccaactgctcatccgtgatcttcacccccatcttctgacccatctgcaggataatttgatccataatcaaacgttccaggatctggtggcgcagcgtggcgtcgtccggaagctgctgacctgcctgacccgcgttgagtttgactgattgcattaagccatcaacgtcgctttccagcacgacgccattattgacgacggctgcgactttatcgactacctggggggcagcgaaactggtattcgcgatcatggcgataccgagaagcagcgttttccagttcttcatactttttccatttcaattaaccgcaatgcggattacgttgtaaatcaatcagattacatagagctttggtacggcagaatgttcgaacgcaacatttcttgcgtgccgaggccgtagttagagctcaaaccgcgcagctcaatgttgaagccaatcgcgttatcataaatcgcgtgttgtttatcgttatcccaaccgttcagcttacgttcgtatccgacgcggatcgcatagcagcaagagttgtactgcaagccgagcatctggtctgcaggtttgctcgaattggtatcgaagtagtacgcgccgacaatcgaccagcgatcggcaatcggccaacttgccaccgcgcccacctggttgatgccgtttttatactgctctgccgtggaataatacgaaggcaacgtagcctgaatatattccgggctggcatagcggtagttcaactgtaccagacgatcctgatcccgacggtattcgaggctgctgctgctggtagcgacgctatccagacgggtatcgtactgcactccgctacgcagcccccagcgttctgaaatacgccagtaagtgtcacctgcccaaaccagcgaaccggttttgtcgtcattctcccatttaatgttgtcatcgccggtgcgagactccgtgaaatagtagatttgaccaacagaaacgttaaaacgttcaacggcggcatcatcataaatgcgtgttgtgacgccggtcgtgacctggttggcggaagcaatacggtcgagaccgccataagtgcggtcgcggaacaggccgttatagtcggattgcagcaaagaagaatcgtagttatagatgccgctctggtcgcggtacggcacatacaggtactgcacgcgtggttccagcgtttgggtataccccggcgccagcatcgccatatcgcgttcgaagacgagcttaccgtcgactttaaactgcggcatgacgcggttaaccgaatcttccagttttttgctgttattggcgttgtaccagtccagattcgtctgctgatagtgcgtcgccatcagcttcgcttcggtgttcagactgccccagcggttggagagcggcagactaatggtcggctccaggtggacgcgggtcgcttccggcatattgtctttggtgttgacaaagtgcaccgcctgaccgtaaatccgggtatcaaacgggccgagatcgttatggtagtagttaacgtctaactgcggctccgctgaatagctgctggtgttctgatcgttaaagacctggaattgtttggtcgacaccgtagcgtcaaagttttgtacggcgtagccgacgctgaatttctgcgttgcgtagccgtcggtactggaaccgtacttactgtcgaaatcattaaagtagctggagtcgctgactttggtgtaatcgacgttaaaacgccacacctgatccatcacgcctgagtgctgccagtagaataaccagcggtgcttatcgccctctttgggatgttcgtcctcgtagactttatcagaaggcagataatctaattccatcaacccggcgccggcctgcgtgagataacggaattcgttctcccacataatattgccgcggcggtgcatatagtgcggggtgatggtggcgtccatattgggcgcgatgttccagtaatacggtaagtagaactcgaaatagttcttggtcgtgtatttcgcgttcgggatcaggaaacctgagcgacgtttgtcaccgacgggtagctgtaaataggggctataaaagatcggaaccggacctactttaaaccgggcgttccagatctccgcaacctgttcttcacggtcatggatgacttcactccccaccacgctccaggtatcggagccaggcagacaggaggtaaagctgccgttttccagaatggtatagcggttttcgccacgctgcttcatgagatcggctttaccgcgcccctgacggcccaccatttggtaatcgccttcccagacgttcgtgtctttggtgttcaggttcgcccagcccttcggccctttaaggatgacctgattgtcatcataatgcacattacccagcgcatcgacggtgcgtacaggttccggctgaccttccgcctgcttctgatgaagctgcacttcatccgcttgcaggcggctattcccctgcataatgtccacgttgccggtaaaaacggcatcgtccgggtagttacctttagcgttatcggcattgatagtaaccggcagatcgttggtatcgccttttaccagaggacgatcgtagctcggcacgcccaacatacactgtgaggcgagatcggctgccagcccctgatgactataaagggcgctggcgatcatggtggccagaagagtgggaatacgttttttcatacgttgtatttattgttccatcatcggtagcgttgcgcgtgacaaacggtcacagcctaacttactcatcttcgctgcgccagtgttaatcctgccgtttagcgtctgtggtgttaggcacggcattgaatgacaggtatgataatgcaaattataggcgatgtcccacaaatgaccgtagccttcattcgcggaaaagcaccttattttgtgggagatagcctcaccgatagcgtaacgttttggggagtctatgcagtactggggaaagataattggcgtcgccgtagccctgatgatgggcggcggcttttggggcgtggtcctgggtctgctggtgggccatatgttcgacaaagcccgcagccgaaaaatggcgtggtttgccaaccagcgggaacggcaggcgctgttttttgccaccacctttgaggtgatgggccacttaaccaaatcaaaaggacgggtgacggaagcggatattcatatcgccagtcagttgatggatcgtatgaatttacacggcgattcacgtactgccgcgcagaacgcctttcgggtcggaaaagcggataattacccattacgtgaaaagatgcggcagtttcgtagcgtctgcttcgggcgttttgatctgatccggatgtttctggaaattcagatccaggcggcgtttgccgatggttcactgcaccctaatgagcgggaagtgctgtatgtgattgcggaagagttaggtatttcccgcgtacagttcgatcagtttctgcgcatgatgcagggcggcgcgcagtttggcggcggttatcatcaacagtccggcggcggctggcagcaggcgcagcgcggcccgacgctggaagatgcctgtaatgtgctgggggttaaaaccaccgatgatgcaaccaccattaaacgcgcttatcgcaaactgatgagcgagcatcatcccgataagctggtggccaaagggttgccgccggaaatgatggagatggcgaagcaaaaagcgcaggaaattcagaaagcgtatgagctaatcaaagaacagaaaggcttcaagtgattgaattgccggatgcggctagcgccttatccggcctacgttaatgaatgtaggccgggcaagcgaagcgctccggcataaattggctcagaatttaaaaatctgccgggactttaaacgtcatgctgttaccgtaagcgggatgggtaatggtcagcatttcggcgtgtaactgcaaacgcggcgccagcgacaacgcttccggcgaggcgtaaaactgatcgcctaagatcgggtggcctaacgccagcatatgcacacgcagctgatgcgaacgcccggtgatcggtttgagcaccacgcgggcggtattatccgccgcaaattccaccacgttatattccgtttgcgccggtttgccggtttcataacacactttctgctttggccggttcggccagtcgcagatgagcggtaagtcgaccagtccttccgccggggagggatgcccccatacgcgcgccacatactgctttttcggctcacgttcgcggaactggcgttttagctcccgctccgcggctttggtcagcgccactacaatcacgccgctggtggccatatccagacgatgcaccgactctgcctgcgggtagtcgcgctggatacgcgtcataatgctgtctttgtgcgcttccagacgccccggcacggacaacaggccgctgggcttattgaccaccataatgtgctcatcctgatacaggataaccagccagggttcctgcggcggattgtagttttccatccccatgtacggctccgttattggtgcgtgacgacgataagacgcagcgcgtccagacgccagcctgcctgattcaggctttccagcacctgctgacggttgctgtcgatagcggcaagttcgtcgtcgcggatgttcgggttgacggcgcgcagcgcttccagacgcgacagttccccggacagtttttcatctgcctcgcggcgcgcgttatcaatcagcgctctggcggactgttcaatctgcgtctcgcccagttgcaaaatggcgtggacgtcctgttgaacggcgttcaccagtttgctaccggtgtggcgattcacggcgctgagctggcggttgaaggtttcaaactcgacctgggcggccagattgttgccgtttttatctaacagcatacgtaccggcgtcggcggcaggaagcggttcagttgtagctgtttcggcgcctgcgcttccacgacgtaaaccagttcgaccagcagcgtgccgacgggcagcgctttatttttcaacagcgaaatggtgctgctgccggtatcgccggagaggatcagatccagtccgttacggatgagcggatgttcccaggtaataaactgcgcatcttcgcgagacagggctacgtcacgttcaaacgtgatagtacaaccgtcttccggcaggccggggaaatccggcaccaacatgtggtcggacggcgtcagcacgatcaggttgtcgccgcgatcatcctggttaatgccgacgatatcgaacaggttcatggcgaacgcgatcaggttggtgtcgtcgtcctgttcttcaatgctttgtgcaagctgttgggctttttcaccaccgttggagttgatctccagcaggcggtcgcggccctgttctaactgggcttttagcgcttcatgttgttcgcggcaggatttgatcagatcgtcaaacccgtcggtttcttcaggcgcggccagatagttaatcagactggcgtaggctgaatcataaatcgcgcgaccggtcgggcaagtgtgctcaaaggcgtccagcccttcgtgataccagcgaaccagcaccgactgggcggttttttccaggtacgggacgtggatctggatatcatgcgcctggccgatacgatccagacgaccaatacgctgttccagcagatccgggttaaacggcaagtcgaacatcaccagattgctggcaaactggaagttacgtccttcggagccgatttcggaacataacagcacctgcgcgccggtatcttcttcggcgaaccaggcggcggcgcggtcgcgttcgataatcgacatgccctcatggaacacggcggcgcggatgccttcgcgttcgcgcagcacctgctccagctgtaacgcggtggtcgccttggcgcagatcaccagcactttttgcgaacgatggctggtcagatagcccatcagccactcaacgcgtgggtcgaagttccaccaggtgccggtatcgccttcgaactcctgataaatttgttccggatagagcatatcgcgggcgcgatcttccgcgcttttacgcgcgcccataatgccggagaccttaatggcggtctgatactgggtcggcagcggcagttttaccgtatgcagttcacgtttcgggaaccccttgacgccgttacgggtgttgcggaacagaacgcggctggtaccgtggcgatccatcagcatcgacaccagctcatcacgggcggcctgcgcgtcgtcgcgatcgctattagcggcctgtaacagcggttcaatatcctgttcgccgatcagatcgcccagtctgttcagttcgtcgttgctgagtttattgcccgccagcagcatggccaccgcatcggcgacagggcggtagtttttctgttcttcgacaaactgttcgaaatcgtggaaacggttcggatcgagcaggcgcagacgggcgaaatggctttccatccccagctgttctggcgtggcggtcagcagcagcacgcccggcacgcgttcagctaactgttcgatggccatatattcacggctcggcgcatcggtgctccacaccagatgatgcgcttcgtcgaccaccagcaaatcccactcggcgtcgcacaaatgttccagacgctgcttattgcggcgggcgaaatccagcgagcagatcaccagttgttcggtttcaaacgggttatacgcgtcgtgctgcgcttcggtatagcgttcgtcatcgaacagcgcgaagcgcaggttgaaacggcgcagcatttctaccagccactggtgttgcagggtttccggaacgatgatcaatacgcgttccgccgcgccggataataactgttgatgcagaatcatcccggcttcaatggttttacctaagcccacttcatccgccagcagtacgcgcggcgcgtggcgacgacccacatcatgagcgatattaagctgatgcgggatcaggttggtccgctgaccgcgcaggccgctgtatggcatccggtactgctcgctctgaaatttacgggcgcgatagcgcagcgcgaaccgatccattcgatcgatttgaccggcgaacagacgatcctggggcttactgaaaaccaacttgctgtcgagcagaacttcgcgcaacgtcacattggtttcttcggtatccaggcgggtgccgacataaacaagcaggccattttcttcttttacttcatcgatatgtagctgccagccttcatggcttgtaatcgtatcgccagggttgaacatgacgcgggtcacgggagaatcactgcgcgcatacaggcggttttcccccgtggacgggaaaagtaaggtgacggttcgcgcatccatcgcaacaacggttccaagtcccagctcgctttctgtatcgctgatccagcgttgaccaagtgtaaaaggcatatgtgttcggctctatatctttaattgcaggcattactcgccattcccaggcgacagcactggataattgcgagtatacgaccccgctaccaggctaatgtggtagtggcgttaattaggtccaggaatggaaagggcgctatggtactggaaggcggcgctttcgtcacgcgtcaaaataaccccagttgcccggtcagtagtgtagcaaaattatcttcaacgaagggaagaattccttccgccacgggttgtagctggcgggtaagatagtgttcgtaatccagcggcgactgctggtaatccacgggctcggggccgttaacagtccagacatattttatggcgccgcgattctgatactgcgccggacgaccctgcttcaggttttgttcatccgccagccgggcggcgcgaacgtgcgacggaacgttacgctggtactcatgtaaagggcgacgcagacgcttacgataaaccagctgcgcgtccagttcgcccgccatcagtttatcgatagtctcgcgcacatagtcttgataaggttcattgcgaaaaacgcgcagatacagctcctgttgaaagcgctgcgccagcggcgtccagtcggtccgcaccgtttccagacctttaaataccatgcgctggctgtcgccttcctgaatcaggcccgcgtagcgttttttactgccagtatccgcgccgcggatggtcggcatcagaaaacggcaaaagtgagtttcaaactccagttccagcgcgctggtcaaattttgctgttgtaacgtctgcgcccaccattcgttcacgtgacgcaccagcctgtgcccgatttccgccgcatcggcttctgaatgcgcgcgccggagccagacgaaagtggaatcggtatcgccataaatcacgtcataaccctgcgcctcaatcagcgctttggtctggcgcataatcgcatgaccgcgcatggtgattgacgacgccagacggggatcgaaaaagcgacaggccgtggtgccgagtacgccataaaaggcgttcataatgattttaagcgcctgcgagagcggtttattgccctgacgtttggcttcatcgcgcccgtgccagatttggctaacaatttccggcaggcagtgcttttctcgtgaaaaccaggcgtcaaggaaaccttcggtactgtgttccgggtccggctgcgccatgccttcgaccagcccgacgggatcaatcaaaaacgtgcggataattgacgggtacaggcttttataatccagcaccagtactgaatcgtataatccgggttgtgaatccattacgtagccgccgggacttgccagcggcggcacttcgccgagattgggcgcgatatagccggcgcggtgcattcgcggaaagtaaagatgcccgaatgcggcgaccgaaccgccgtggcgatcgaccggcaggccgttgatcgtcgcgcgttccaacaaaaacggcatgatttcggttttatggaaaatgcgcgtgaccagctcgcagtctttcaggttgtaggtggcgagggcgggtttatcctgggcaaagcggcgatcgatctcatccatacgatcccaggggttatcaatggattttccttcgccgagcagttcctgcgagacggcttccagcgaaaaagacgaaaaattccagaacgcggatttaagcgcgtcgataccatcgataatgactcgccctctggcctgggcgaaaaaaacgccgtttttgaagccatgttcgcgccactccagttcgctattgtctcgccccagccgtaaagggatacggtagcgttcggcatatttttgcagcatacgcaggtcgaactgcaccacgttccagccgatgatgacgtcaggatcatgttcggcaaaccaggcgttgagtttttccagcaactgcgggcggctggcgacatacacaagctcgaagtccagttggcgctcatcgccgttcgccgggcccagcatataaacggtacgctggccgcagccttccagaccaatgcaatacagctcgccgtgtcgcgtggtttcgatatccagcgagacccattttagcggcggtcgatagtcggggtggggtttaagacgcgcattgcggataacgccgttgcgcatctcgccatctacccaaacaggcgaagtgataaaacgttccatcaggtaacgctccggcgggcggacatccgcttcataaacggtgacgccgttttcgcgcagcagtttctccatccgcataagctggcggtgagtgcggcaatacagaccggataccggctgacggtgaaagtctcgcagctggagcggcgtcaggcgatagtctttttccgcctgtagcagcgaggcggcgcgggaggtctggctggtcggaataaacgccacggactcttgcggcgccagcgtcgcctgcaaagggccgttgtctgtcgccagccagaaagagacctccgtcccttgcggcgtatcccgccagtgccgggttaaaatgaaacctgcctgcgccacgatgattacctgtctaaaaaattcacgctaattataacctgttttagggggtaatactgttattttgtacaggcatataacgtaaaagccgatatccgctgtaataaaaagtttctcgcagtaagaagcgggtttgcgcccaccaggatttatagcgggtggctcgcgtgggtgatgagcggctatcgataccattatcctgagcgatagttttcagacgcagcatatgcagcggatcgctgaccagtaacgctgtgcaccatcttaactccaaagggtactcccgccgacataaggcgggaggggaatttggacgggcttgaaaagcccgaaggatcatcagccacgctgatgttgaatgtattgcttcacaacttccagcggcgcacctccgcacgagccagcaaagtatgacctcgaccagagcacggcttttccgtatgctccccgcaaatcaataaattcgtttcgcagacggcgggatgtcacagctttcagtgagttaaccagtaccgaaagctgcactgttggtgggtattcgatcagcatgtggacatgatcgacgtctccgttactttctttaagttctccgccaaaatcacggcagacttctgctgcatactgatggaatgcagcatagtgtgactcacccagtatctttcgacggtattttgttataaagacaagatgaacatgcaaaaggaaggcggcatgtcttgaacgattaattttatgtttttgtattgaagttgaccgtaaaaacagtaacgtagcaaacaaatctcctacacactgagtgatgatgctaatcctgaaagcctacaaattcagactggaaccaacgcctgaacagtcgcagcgtttgcggcagttatgtggttgcgcccgttttgtctggaatttaggtcttgcggagacaaagcgcatccttggttcaggcgaaaagttaccttcggctttcgagttgaacaggatgcttacagtgtggaaaaaaatgccgggacacatctttttacaggatgcttataccgacaatctgcaacaaaagttgaaagacctgcatactgcatggaaacgttgctttgataaaaagctcgcagctaaggccccggtatggaaacgaaaaaatgagggcagagactcaatccgttttgtgaactttgagaaatattgccgccttgaaaatcgcagagtgaagctaccgtcaggtcttgggtgggtaaaattccggcaatctcaacgtgtgaacggtaaaatcaaaaatgcgacaatcagtcagttagcgggacagtggtatatctcgtttcaggttgaagttgaaacggcagaacccaatcacacaagcacaacgatagtcggtctggacgcaggagtaacaaaactcgccacgctttcagacggtacggtataccaaccagtcaacagttttaaagcaagtcagcgcaagctggcaacactccagcggcagttaagccgtaaagtcagattcagcagtaactggcagaaacaaaagcgaaaagtccagcatctgcactcgcacatagccaatatccggcgcgactaccttcataaagttaccagtgaaatcagcaaaaaccacgcgatgatagtcattgaggatttgaaggttagtaacatgtcgaaatcggcaaaaggtacagcagaacagcacggacgaaacgtcaaggccaaatcaggtctgaaccgttcgatactggatcagggctggtatgaaatgcgccgccagcttgagtacaaacagctctggcgtggcggtcaggtgcttgcggttccgccagcatacacaagccagcgttgcgcgtgctgtggtcataccgcgaaagaaaatcgcctgtcacaaagtaaatttgtgtgtcaggcatgcggatatacagcgaacgctgatgtaaacggcgctcgtaacattttagcggcggggcacgccgttcttgcctgtggagggatggtgcagtcaggccgcccgtctgaaacaggaaccagacgctgagcaatcagtcgtcacccactaatgggaattccccacctgagtcacgaagtgcgaaggtgggggaggatgtcaatgttgttgtcgcagtatctgttttgcgtaacgaatattttcgcgcgtcacggtagagcgctcttcaataaaaatcgccttagccggaatgcctttttccagaacgtattgacgggctatcgccgcgtcggaaaccgttgcgccagcgccgtagccgccggttaataccaacgcgcggacaatgtgttgttggtaaagccagatggcatgatccagtctggcctgaaaaacgggagaaggcgtttttccgctaacgcctgctcctgcgacaatcgcgcagtcagctacgcgcgtctggttttgctgactgaactgataaatagcgatagcgttatggataaacaccatggccataatgagaatgatgcctgccgcgattctgaggatgtagcgatatttcatgaatgagttcgttccccgtgacgggtgtaatgaatattttaacgataaaatggcttttagcgtcagatatttttgctgacgtatatttatcaatataatgatgccggtatatacagcagatataattatcctataactgctaattttgaatcatgtttatttacagtttttacccatgtattagccgttttgtgtcaagtctgttttcatacattaagtatttttcagaaaggcgcttgttcgaatctgttacttatttctcggattaacaaaaaagcgatattttttgtttgttttaattaatgaaaagtgtaacaatttcatttggaacatccgcaccgtcaggtagaaatataatattccaattggccgctatggttaaataaaaatggattacagtgcgaattcgtcgggaactctctgcataatttaatttttattttagaatataattttattttgactttcgggtgcgggtgtttttatcaaaatttgtggtattcaggaatgatcttttatgaatgtgagtatgcaggcgcgtctggtagggagcgaccgttatcttttcgtcaatactcaacgcgctaacccttccataaaaaccgtgagtcgattttttgagtataaaacatggacagaacagatttggcgtaccgagattattgaaaacggcaatgctttttttcactggcaaggacacgacagaaaagacggacatcgggataccattattaattatctgttaaatgggcaacgctggcagtcaacaatcgaagattatattttcttccatgcgctggaaggaaaagcgtggcagggacattatgataatattattgaatatgtgagttctgatcattacgtctatcaaagcgcatttgctgaatatatcaccgaccagattcatcaacgcgccccccatgggacgcgtttttagaggcattactgcccgtaataggcttttgcgccgtgtttgcgtaaatagtgtttatccagcagggattgctgcatgtcgggcaactgcggcgcaagctggcggcagaagatccccatataggccacttcttccagcacgatggcgttatgcacggcatcctcggcatttttaccccaggcaaacgggccgtgcgaatggacaagcacgccgggcatttgagcggcgttaatgccttgtttttcaaaggcttcaacaatgacattgcccgtttcccattcatactcgccattaatttccgcctcggtcattttgcgagtgcagggaatcgtaccgtagaaatagtcggcgtgggtggtgcccgtcgccggaatcggctgacccgcctgcgcccagatagtcgcgtggcgcgaatgggtgtgtacgatgctgccgatagtcggaaatgcctgatataacagacggtgggttggcgtatcggacgacggtttcttatgaccttcaacgacttcaccggtctccaggctgaccaccaccatatcgtcagcggtcatgacgctataatcgacgccggacggcttaatcaccagtacgccgcgttcgcgatcgacggcgctaacgttaccccaggtgagggtgaccaggttgtgttttggcagcgccagattggcttccagtacctggtgtttgagatcttctaacattgttttctccctgccggatggcgcttcgcttatccggcctacgagcgacggtgtgccggatggcgacataaatgccttattcggcctacaggaccgtaggcccggtaaacgcagtgccaccgggcattcagacaccacttttagcgttttaaaccgtaatacacctcgttccagcgcagcgcgtccttaaaggctggcagacgggtatcgttatcaatcaccgcgatttcgatatcgtgtatttctgcgaactggcgcatatcgttcagatccagcgcgtggctgaagacggtatggtgcgcgccgccagccagaatccacgcttcggaggcggtcggcagatccggctgcgccttccacagcgcgttagccaccggcagtttcggcagggagtgcggcgtttttacggtgtcaatgcagttgaccagcaggcggtaacgatcgccgaggtcgatcaggctggcgacgatcgccgggccggtttgggtattgaaaatcaaacgcgccggatcttccttgccgccaatgccgaggtgctggacgtcgaggatcggtttctcttccaccgcgatggagggacacacttccagcatgtgcgagccgagcaccagatcgttgcctttctcgaagtggtcagtgtaatcctccataaatgaggtgccgccctgcagaccggttgacatcactttcataatgcgaagcagagcggcggttttccagtcgccttcgcccgcaaagccgtagccctgctgcatcagacgctgtacggccagacccggaagttgtttcagaccgtgtaaatcttcaaaagtagtagtgaatgcgtggaagccgccctgttccaggaaacgcttcatccccagttcaatgcgcgccgcttcccgcacgttctggcgtttatcgccgtggatctgggtggcgggcgtcagggtatagctgctttcatactcgtcaatcagagcgctgatatcgccgtcgccgatagaattcaccacctgcaccagatcgccgaccgcccaggtattgaccgaaaagccaaatttgatttgcgcggccactttatcaccgtcagtcactgcgacttcacgcatattgtcgccgaagcggcagacttttagctggcgggtatcctgtttagagaccgcctggcgcatccaggcgccgatacgcgtatgggcctctttatcctgccagtggccagtgacgaccgcgtgctgctggcgcatccgcgcgccgataaaaccgaactctcggccgccatgcgcagtctggttcaggttcataaagtccatatcgatgctgtcccacggcagggcggcgttaaattgggtatggaattgcagtagtggtttgttaaggatactcagcccgttgatccacattttggccggggagaaggtgtgcagccagaccaccagccccgcgcagcgatcgtcataattggcgtcacgacaaatggcggtaatctcatccggcgaggtgcccagcggttttaataccagtttacatggcagtttggcttcggtattcagcgcgttgaccacatgctcggcatgttgggtgacctggcgcagggtttctgcgccatacaaatgctggctgccaatcacaaaccatacttcataattatcaaaaatcgtcattgtcgtgtccttaatgagtcaggattgcctgattggccggggtcgttggcgccggcgcggcagtcggaagataatgttgttctgcgcttagcgcccactgctggtagcggcggtaaagccgttcgaagcgttgcgcctgttcagggcggggacgcagagtgcgttctaccgcgctcgccatgctttgctgggcggcaggaatatcggcatggactttcgcggcaacggcggcaaagatagcggcgcctaatgcgcaacattggtcggaagcgacgatctgcaacggacgattcagtacgtcgcagcagacctgcataatgacctgatttttacgggcgatgccgccaagcgccatcacgttattgaccgcgataccctgctcggtaaaacactcctgaatggcgcgcgcgccgaaggcggtcgaggcgaccagaccgccaaacagcgctggcgcgtcggtggcgagattgagatcggtaatgacgcctttcagacgctggttggcattgggtgtacggcgaccattgaaccagtcgagcaccaccggcaggtgatccagggacggatttttcgcccaggcgtcggtgagcgctggcaatagctgcttctggctggcgttaatctgggttttcagttccgggtgctgcgcggcaagttgttccagcggccagctcaacacgcggctaaaccaggcgtagatgtcgccgaaagcggactggcccgcttccagaccgataaagttcggcaccacgctgccgtcaacctgaccgcaaatgcctttcacggcgcgatccccgacgctctgtttatccgcaatcagaatgtcgcaggttgacgtgccgatgacttttaccagcgtattgggctgtgcgcccgcgccgaccgcgcccatgtgacagtcgaacgcgccgccggaaatcaccacgctttccggcaagccgaggcgctgcgcccattcggcgcacagggtgcccacgggcagatcggcggtgaaggtttcgctaaataacgggtagcgcagatgacggttaatgcacggatcgagttcatcaaagaagctcgcgggcggcagaccgccccagctttcatgccacagtgttttgtgcccagcgctgcagcggccacggcggatatcctgcgggcgagtggtgccggaaagcagcgccggcacccagtcacacagttcaatccacgagacggcggcctgcgcgacggcgctatcctggcgggtgacgtgcagaatcttcgcccagaaccattcgctggagtaaatgccgccaatatagcgggagtagtcgaccttacctggcttatggcacagacgagtgatttcgtcggcttcttccacggcggtgtgatctttccacagcacaaacatcgcattcgggttctcggcgaactccggacgcagcgccaggacgttaccgtcggcgtcaatcggcgctggcgtagaaccggtgctgtcaacgccaatgccaacgacatttgcgcgttgcgcggcgcttaattgtgccagaacggctttcagcgcggcctccattgactccatgtagtcgcgcggatgatgacggaactggttgttcgggccgtcgcaataacggccttcttgccagcgcagataccactctacgctggtggcgatctcgtcgccggtggcgcagtccactgccagagcgcgcactgaatcactgccaaaatcgaggccaattgcaattgccatcgtcttactccatccagaaaaacaggtatggagaaacagtagagagtcgcggcaaaaaccgtcaggcaggatccgctaatcttatggacaaaaatgctaatgctttgcaaagtgtgacgctgtgcaaatattcaatgtggacattccagccatagttatagacacttctgttacttaattttatcgcctgaactgtacgcttttgttacaaagcgcttttcacaagcggggttgatacgtgctttcatcaagcgcaaggtcttgcggagacggaagctctgtcgtcctggtcaatatggacaatttgtttcttctctgaacatcggggggtagagaaatcatggctgaaacgcaaaatgatccgctattgccgggatattcatttaatgcccatctggtcgccgggctgacgccaattgaagcgaatggatatctggatttttttatcgatcgtccgttgggcatgaagggatatattcttaacctgaccatccgcggagagggcgtcattaataataatggcgagcagtttgtctgtcggcctggcgatatattattgtttccgccgggcgagattcatcactatggacggcatccggatgccagcgggtggtatcaccagtgggtttatttccggcctcgcgcctactggcaggagtggctgacctggccgacaatctttgctcagacaggatttttccgcccggacgaggcgcgccagccgcatttcagcgaactgttcgggcagatcatcagcgccgggcaaggggaaggtcgctattctgagctactggcgatcaatctgctggagcagttgttgctcagacgtatggcggtaattaatgagtcgttgcatccgccgatggatagccgtgtgcgcgatgcctgccagtatatcagcgaccatctggcagacagtcattttgatatcgccagcgtcgcccagcatgtctgcctgtcgccctcccggttatcgcatctgttccgccagcagttaggcattagcgtattgagctggcgcgaagatcagcgtatcagccaggcgaaactcctgcttagcaccacgcgaatgccgatagcgaccgttgggcgcaatgttggatttgacgatcagctctatttttcgcgggtatttaaaaaatgcaccggggcaagtcctagcgagttcagggccagatgtgaataaaaagtgaatgatgtgtccacaaagatgtcataagccgtaactattcggataattgacggcttgacgaagggggacggggtaagcagaatccctgcttcatcacgctgacggacacactatgcaagcactgctggaacactttatcacccaatccactctgtattcgctcatcgccgtgttgctggtcgccttcctggaatcgctggcgctggtggggttgattttacccggcacggtactgatggcggggctgggcgcgcttatcggcagcggcgagctcaatttttggcatacctggctggtgggtattatcggctgtctgatgggcgactggatttcgttctggctggggtggcgctttaaaaagccgctacaccgctggtcttttatgaaaaagaacaagtcgctgctggataaaaccgaacatgcgctgcatcagcacagtatgttcacgatcctggtcggacgttttgtcggtccgacgaggccgctggtgccgatggtggcagggatgctggatcttcccgtagcgaaatttattgggccaaacttgattggctgtttgctgtggccgccgttttatttcctgccgggcattctggcgggagcggcaatcgatattccttccgatatgcagagcggagatttcaaatggctgctgctggcgacggcgttgctgctgtgggtcggaggctggctatgctggcggctgtggcgcagcggcaaagcggcagtcgatcgtttaaccgcgtatctcccccgcagccgtttgctgtatctggcgccgttgacgctcgggatcggcgtggtcgcgctggtggtgctggttcgccacccgctgatgccggtgtatatcgatattctgcgcaaagttgtgggttactaacgattcctttgccggatggcggcttcgccttatccggcctacaaaatatgggatttgatgcccaatagcgctgaggcgctggcttgaccgcttagtagctcgtctgttttgccttgccacgcaatgcgtccgtcggcgacgacgattgaccggggcgcaatccgcgccgcatcttccacgctgtgcgagaccatcaacagcgtgagctgtcgctcgcggcagatatcgctgaccaacgtcagcatctcctggcgcagcgcgggatcgagcgcggagaacggttcatccagcagcagcaccggctgttcacgtaccaggcagcgcgccagcgctacccgctgacgctgcccgccggacagttcgcccggtaaacgcgccatcagactctcaatgcccatctgacgtgcgatagcgtcccgtttttcccgctggctggcgttgagcgttaacccagggtttagccccagaccgatattttgctgcacattcaggtggctgaataaattattctcctgaaacagcattgagaccggacggcgtgagggcggcgtaagcgtatggtcttcgccggcaatcagtagcgtaccgctggcaggcgcaagaaaaccggcaattaaattcaacaacgtgcttttccccgcgccgctggggccaagaatcgccacctgctcgccgcgttctaccgccagcgtaaaacgcatcggcaaatgatggtaaagccaggtgatatcaatcagttttagcatgtcggcccggtagtttctctatgagggtaaataacgtaaaacagagcagcaacagtatcagcgcggtcaccgcgccgtcctggctgcggtaggagccgatctgctgatacagataaaacggcagcgtgcggaaattgtcattgccgaaaagcgcgacgacgccaaaatcaccgatagaaagtacgcaggcaaacgccagcgcctgcgccagcggacgtttcagcgcccgcagttccacgacctttaaccgcgaccagccttcaattcccaatgactggcacagcattccataacgggcggtaatatcgcgcattgggttttccaggacttttagcgcgtaggggattgccatcagcgcattggtgaaaatcacgatgccgtcggcggattccggtaagccaacgctgttattgagcagtaaaaagaagcctgtcgccagcacgatccccggcatcgcgaggatcaacattccgctgagttccagcgtttgtccggcgaatagttgctggcgttggtgtagctcgcggctactccacagcagcatcatggtcagcaccacacacagaacgcccgccgccagcgcaatgcgtagcgatgtccagacagcctgccacagaatgggttgcgccagcacttccggcaggctgcggttgacgccatcgaccaccacggcgaccagcggcggaagcagcaatagtagcgccagcacgattaataaggcgtccgtcagacggctgtggagacgatcgtcaggatcgcgccagccctgcgtcagcgtcatccccggcgcaatcgctttgctcaaccgttgacttagcagtaccagcgccaggcagcagaccatctggattaatgccagcatcgccgcgcgggcgggatcgtagtcataactgagcgcctgaaagatagccagttcgatagtggtggcctgcgggccgccgccgagcgacaggaccgttgcgaaactggcgaagcagagcataaaaatcagcgccgcgacgggcggaatttggcggcgcagccacggccattcgacaaaacggaaaaaatgccagccgcgcataccgagctgggcggcgagctggcgctgctcgccgggaatgctttccaacgattgcagcaacaaacggctcgccattggcagattaaaaaagacgtgcgccagtaaaatgccctgcaagccgtagggggagaatgtccactgaagccccagcatctgccacagcgaggccagccagccctgacgtccatacacgctaagaatgccgaacacggcaaccagtaccggcagaatcagcgtcatggcgcacagacgcagcagcgccagacgtccaggaaaacggcgtcgataaagcgcgcgggcgagaaaaaccgccgggaccacagacagcactgcggacagaaacgcctgccagaatgagaagcgcaccacatgccacagatagctatcccgccagagtgtcgaccacgcgcccgacggcgcgttcagccaaagcgccagaaaggccgccagcgagacggttatcatcagcgcggcggcgcacagccccggaatcagccagccgggaattaacggctgacggcgcgttgccattcgctaatccatgcctggcgttgtgctgccacttgttgcggcgtgaattccagcgttgtggcgggtttggccaatgattcaaaccctgcgggtaaggcgacgtccgctaccgggtacatccagttgccggtgggtatggcgttctgaaacgccggagaaaccataaatttgaggaatttctccgccagttccggctgcttactggcgacggtacgcgccgcgacttctacctgtaagtaatggccttcgctgaagttcgcggcggcgtaattgtccttcttctcttcaataatgtgatacgccggagaggtggtgtaactgagcaccaaatcgctttcacctttcagaaataaaccgtaggcctcgctccagcctttcgtcaccgtcaccgttttggccgccagtttttgccaggcctgcggcgcgttatcgccataaactttgcgcatccacagtaacagccccagccctggcgtactggtacgcggatcctgataaatcacccgccatttttgatcgctctcgaccagttctttcaggcttttcggcggatttttcagcttgcttttatcgtagacaaaggcgaaatagccgtaatcgaacggcacaaatgtgtcgtttttccagccgccgggcaccttgaccgcctcattcgccacgccgcttttggcaaagagtttagtttgcgtggccgcctccagcagattattgtccagccccaacaccacatcggctttgctgttcttcccctccatccgcaggcggttgagcagcgaaacgccatcctccagcgccaccagtttcagctcgcagttgcaatcggcttcaaacgcttttttcaccgccgggcctggcccccagtcggcggcgaacgagtcgtaggtatagacggtgagaacgggtttggcgaaagcaggcgccgcgcacaggagtaaaagcggaagatatttttttaacactttgcacctcagttaaagagtggcaaaggacttgagaggtagcctcaaatcccttcgccggcattatccggatcaggttcgacgggtattttctcagcgcgcgcatgagcgcggcaccccgttgagttcggcgttagtgtagtgattttgttgccgggcagcaatcaagagctggcgttaaggatctggcggcgcaaaccacgccgatttaaaatcaaaccagccgagggtattcatgcgcagcccgcgcatactgcgttgtccctggataatcagccagtggtggatcaacggcacaatcgctttgttggccagcagttgctggcaccagttcgccaggttcatctcgccagcgcgccactgcgcggcgtcgtcctgccagtcgcgcggaatgcagttctgcaagagcggtacttcgcacaggtgcgcgaacagcgagaaatccagcggcagcgtaaagttagcgctattgagccagatatcgctttcgatctcgccggcgtgccattgatcgtagtcgatctcctgaatatgcagatgcacctgatgttcagccagaagcgcgctcatgatacgggcgataacccggtgctcaatgtgttcgcgatagaaggtcagcgtgagggtttccagcccggcgggtttttcgcccgggcctggacgggcgtggtgccagcgcggtaaaagcccataggccgggaaccagagctgctgtagcggttcatcggcatgatagagtaaattggtgggggagaggacgtggcttacccattctctgacctgcggatgcgcgccgcgcggcgttctggcgtcgaatagcaggtaatagcacccctcttccagtcggctttctatcgctttttcaccgccttgtattggcccttccagcatcaagccgcaggccggttcttcactgatatccggcagtacccagacgttcacttcgtctatcaacgcccgatagccgaagtaatcatcaaaggcgagtatcttgagctggtttggcgtattacgccgcacggcataaggcccggtgccgatagggtggctggcgaaattagccagcgtttcccactcccgcggcaaaatcatcgccgggacctggcccagcagccacggcaaccagcgatccggctgggaaagatgaatatccagcgtccacgcggtaggggagtctatctttgtgatgtgcgagtaaagcggaagcgtattgatacgcgtcagcgaggcgatgacatcttccatctccagctcgcggccatgatgaaaatgaatgccggggcgcaggtagaagcgccacagtaaaggggaaatttgctgccagtggtgcgcaatgtccgcttccagttccccgttttcctcatttacccgcgtgagcgaactgaaaatttgccgggcaatatgagtttccgagcgacgtaatgcggttcccggcaggagattgtgcatcggacgatagtaaagaacccgcagaatatgccgcccctggcggaagctgcgtcccagatgggaaatcagcatttgcctgacagcgcttttatcgccgaccagttgtaccagttgatcgattcgatcttgttccagcaggtcttccgcccgctgctgttgcagcgccagtccggtatacaggaacgtcagacgcgaacgctttccgcgtccgacctcggcttcccatgttagccaaccgcgcgcctgcatcgtatttagcagcgtacgcatatggcgacgcgaacagttcagcagatccgccagctcattaagcgtggtgtcttgcgttttaccgtcacaacattgccagagacggataaattgttgttgcaggcgacctgagggcataaaaggggaactccgatgaaaaactcagcaattttattatccctatattaggccaataatatctttcgatgaagcaagaggaagaggtcactatgcgccagttctggttgagatattttgccgcgacggaaaaaacgtcctggctggcttgcctgagcgcgccgcagcgcttaaaaatgctcgcggaactgatgcagtgggaggcgaccgattgaagccaattgcagacatcatgtgtgactgagtattggtgtaggcgatagcctaaaatcacccgccagcagataatatctgctggcttttttatttcggctgtttctggatgacgacgatgggacggcgtctcaacgggatttctgcggcggtttctgtggtcacgcgggtgatgaccgggcgagtaaaagacgtataaaaaatgccggaatatccccggcatgagcgactgatgagtaaccaggcgcttgatggcgctacgcttatcaggcctacagaatatagtggcaacctggtgatattgcataccctgtaggcccggtaaggcgtgaaaggttaccgcataaatgccggttgtttattttcgtactcggcaatcgcgtcttcgtgctgcagcgtcagcccgatgctgtccagaccgttcaacatgcagtggcggcggaagtcgtcgattttaaaactgtaggtcttatcgcctgctttcaccacctgtgcttccagatccacttcaaatttaatgcccggattggctttcaccagcgtaaacagctcatcgacctgttcgtcgcttaacttcaccggcagcagttggttattgaaactgttgccgtagaagatgtcggcgaagcttggcgcgatcaccactttaaaaccgtaatcggtcaacgcccacggcgcgtgttcgcgtgaagagccgcagccaaagttttcccgcgccaacagtatcgacgcgccttgatattccggaaagttcaacacgaattccggatttggctgttggcccttttcgtccaggaaacgccagtcgttaaacagatgggcgccaaaaccggtgcgcgtaaccttctgcaaaaactgtttagggataattgcatcggtatcgacgttggcggcatccagtgggacaaccaggccggtatgctgggtaaatttctctgccatggtagtttccttatttgatgctgcgaatatcggcgaagtggccggtaacggcggcagcggcggccatcgccgggctgactaaatgcgtgcgacccccgcggccctgacgaccttcaaagttacggttgctggtggaggcgcagcgctcgcccgggttcaggcggtcattattcatggccaggcacatggaacagcctggtaagcgccattcaaatcctgcttcgataaagatcttgtccagaccttccgcttccgcctgcgctttcaccggacctgaacccggcaccaccagcgcctgcacgccaggcgcaactttgcgccctttggcgacttccgccgccgcgcgcaaatcttcaatacgcgaattggtacaagagccgataaagactttatcaatagcaacgtctgttaacggtacgcccggctgtaagcccatataagccagcgctttttcggcgctggcgcgctcaaccggatcgctaaaagaggcgggatcggggatgatgtcggtgacggaaatcacctggcccggattagtgccccaggtcacctgcggcgcgatctcttctgctcgcagggtgacgacagtatcaaaggtcgcgccgtcatcggttttcagcgttttccagtactcgacggcttcgtcaaaatcgcggcccttcggcgcgtgcaaacgcccttttacgtagttgaaagtggtttcatccggggcgaccagaccggctttggcgcccatctcaatcgccatattgcacagcgtcatgcggccttccatactcagcgcgcggatagcgtcgccgcaaaattcaaccacgtgtccggtgccgccggcgctaccagttttaccgatgatcgccagcacgatgtctttggcggtaatgcccggtgcggcgttgcccgtgacttcaatcttcatggttttagcgcgcccctgtttcagggtttgcgtcgccagtacatgttctacctcagaagtgccgatgccgaaggccaacgcgccaaacgcgccgtgggtagcggtgtgggagtcgccgcagacgatggtcatacccggcagggtaacgccctgttccggccccatcacatggacgatgccctgatatgggtgattcaggtcatacagctcgacgccgaactcgttacagttcttaatcagctcttgcatctggatacgcgccatttcaccagaagcattaatgtctttagtctgcgtcgagacgttgtgatccatcgtggcgaaggttttccccggctgacgtaccggacgatggtgcgcgcgcagaccgtcaaacgcctgcggcgaggtcacttcgtgtaccaggtggcgatcgatgtacagcagcggcgtttcgtttggcgcctcaaagaccacgtgggcatcaaataatttttcgtataacgttttggccatgattacaccccttctgcgacatagcgggcgataatatcgcccatctcatcggtactgactgcggcagcgcccctggctaaatcgctggtgcgaaccccctcttctaatgcgcgattgatcgcctgttcaatggccgttgccgcctcatcggcatccaggctgtagcgcagcagcagcgccagcgacaggatctgcgcaattgggttggcgatatttttcccagcgatatccggcgcggagccgccagccggttcatacaggccaaactcttgctcgttcaggctggcggagggcaacatccccattgagccggtgatcatggcgcattcgtcggacagaatgtcgccgaacaggttagagcacagcaggacgtcaaactgcgacgggtctttaatcaactgcatggtggcgttatcgatatacatgtgcgcgagttccacatcgggatacgctttcgcgacatcattgacgatctcacgccacaggatagagctttgcagtacgttggctttatctatagaggtgactttacggcggcgtttacgcgccgattcaaaggcgatacgggcaatgcgctcgatctcaaagcggtgataaacttcggtatcaaaggctttttcgtactgaccgctgccttcacggccttttggctgtccgaaatagatcccgccggtcagctcgcgcacgcacaggatatcgaaaccgttagcggcgatatcggcgcgcaacgggcaaaatgcttccagtccctgatacagtttcgccggacgcaggttactgaataatttgaaatgtttgcgcagcggcagcagggcgccgcgctccggctggctttccgggggcaaattttcccatttcgggccgccgacggagccaaacagaatggcatccgcctgctcacacccttcaacggtggctttcggcagtggatgaccatgattgtcgatagcaataccgccgacgtcatagcggctggtggtgatacgcatatcaaaacggctgcgtaccgcatccataactttcagggcttgcgccatgacttccgggccgataccgtcgcccggcagtacggcaatatgatagttcttcgacattacacggtttccttgttgttctctttattttgagctttgcgttgcaattctttttcaacttcggcggcgcgccagatattgttcagtacgtgtaccatcgctttggcggaggattcgacgatatccgtcgccagcccgacgccgtggaagcggcgaccatgatggttcacgacgatatcgacctgacccagcgcgtctttgccctggcctttggcgttcaggtcgtatttaaccaactcaacgtcgtagccagtgatgcggttaatcgcctgatagatggcgtcgaccgggccgttgccgttcgccgcctcggccttgatctcttcaccacaggccagcttcacggaagcggtggcgatatcgctggagccggactgcacgctgaagtaatccagacggaaatgctctggttcttcttgctgtttattaataaacgccagcgcttccaggtcatagtcgaacacctggccttttttgtccgccagcttcaggaacgcgtcgtacaggtggcccatgttgtagtctgtgtccttgtaacccatctcttccatgcgatgtttcacggcggcacggccagagcgggaggtcaggttcagctgtatctggttcagaccgatggactctggcgtcatgatttcatagttttcgcggttcttgaggacgccatcctggtggatgccggaagagtgggcaaaagcgccgctgccaacaatcgctttgttggccgggatcggcatgttacagatctggctgacggtctggctggtgcgccagatttcgtggtgattgatgttggtgtgtacgtttatgatgtctttgcgcactttaatcgccatgatcacctcttccagcgcgcagttaccggcacgttctccgataccgttcatcgcgccttcaacttgacgcgcgcccgcatgtactgccgccagcgagttgcctaccgctatccctaaatcgtcgtgggtatgaacggagatgatagctttgtcgatattggggacacgttcatacagaccggaaatgattcccgcgaactcaaacggcatggtatagcccacggtatcgggaatattgatggttctcgcgccggcgtttatagcggcttccaccacgcgcgccagatcgtcaacaggcgtccggccagcatcctcgcaggagaactccacgtcatcagtgtaattacgcgcccgcttaaccatgtataccgcgcgttcgatgacctcatccagcgtgctgcgcagcttggtggcgatgtgcattggcgaggtggcgataaaagtatggatacgaaacgcgtcggcgaccttcagcgcctgtgccgcaacgtcgatgtctttttctacacaacgcgccagggcgcaaacgcggctgtttttgatggtgcgggcgatggtttggacggattcaaaatcacccggagaagagaccgggaagcccacttccatgacatcgacacccatgcgctcaagggccagggcaatctgcagcttctctttcgcgctcaggctggcctgtaacgcttgttcgccgtcgcgtaaggtcgtatcaaaaataatgacttgctggctcatgatgtggtccttgtctccaggggcgccttgcgtcaggcataaaaaaacccgcacaacggcgcgggttttgtttgacttcgagctgacttaatgttgaatgccgcccaccggtctaccgcgcacaataaatgcgttgagtagtagtagcccagtgaaacgaacgatatatgacattaattctagctccagcgaatgcgttatgcttttagtggtactggatatgccgtttaatgtcaactctattttctgtcgccattgcattttgttgacgatatccggatacgtactttagctaattgtgctgggctgcgcgtccaataaaggataaaagaacgagtggacattcatacttttcattgtttgaaatatttaggcatttttgtttgcaaattggttaggggaatggcctgttaaaggtatgctaaaggtttggtttatctttttgatttgttttatattttaacaaataaccttgtttgcttaatggataaggataaagttattgataaattaatgttaactttttagctattaataatataaacatttaattgaaacttaaatgatcattcacttggtgtatgattgtgtattcgccatagttatggttatattgcttgcgtaatttaaacattatgaatcgcaatggtgtgactcaggacatattacgcttgcgctggcattctatttgtctctgtcagcgtctttatgttttccgaattttaacgctttccctttttcttattttatatgcatggtaaatcatattttcaggaattatttctgccttcagccagaaaaagggagttaagcgtgacagtggagttaaatatgccagaggtcaaaaccgaaaagccgcatcttttagatatgggcaaaccacagcttcgcatggttgatttgaacctattgaccgtgttcgatgcggtaatgcaagagcagaatattacgcgcgccgcccacacgctgggaatgtcgcagcctgcggtcagtaacgccgtagcgcgtctgaaggttatgtttaatgacgaactttttgttcgatatggacgaggaattcagccgactgcccgtgcatttcagttatttggttcagtccgtcaggcgttgcaattggtgcaaaatgaattgccgggatcggggtttgagccgaccagcagcgaacgtgtattcaatctttgcgtgtgcagtccgctggataatatcctgacgtcacagatttataatcgtgtagaaaaaattgcgccaaatattcatgtcgtttttaaagcgtcgttgaatcagaatactgagcatcagttacgctatcaggaaaccgagttcgttattagttatgaagaattccgtcgtcctgagtttaccagcgtaccgctatttaaagatgaaatggttttagtcgccagccgaaaacacccgcgtattagcggcccgctactggaaggcgatgtttataatgaacaacatgcggttgtttctctcgatcgttatgcgtcatttagtcggccgtggtatgacacgccggataaacagtcgagcgtggcttatcagggcatggcgcttatcagcgttctgaacgtggtttcgcagacgcatttggtcgctattgccccgcgctggctggcggaagagtttgcggagtcgctggagctgcaaatactgccgttgcctttaaaactgaatagccggacatgctacctttcctggcatgaagcggctgggcgtgataaagggcatcaatggatggaagatttattagtctctgtttgtaagcgataaaaccgggcagaataaatcagaaacaaattctggtttattctgctttttagcgtatgtcaaaaattttatgctgaattaacggtgagcgattcttttcgtcgctgtgaaaaatagatgaattgctgtaagtctgcatttataagcgattatttattacctggtgtgattcagacggagtatttctccatttcttctcttcttgcctcctgattattctaaccttccccatctttacgtcattccacccaattgccaggcgtgatagcgagcggttaaggtgtccgtcaaaccgtaatgacaggtataaagtggaggcaagccgtggagatgttgtctggagccgagatggtcgtccgatcgcttatcgatcaaggcgtaaagcaggtgttcggctatcctggaggcgcagtgcttgatatttatgatgcgctacataccgttggagggatcgatcatgtgctggtgcgtcatgagcaggccgcggtgcatatggcggatggcctggcgcgagccactggcgacgttggcgtggtgctggtgacttccggaccgggagcgaccaatgcgattacagggattgctacggcctatatggattccattccgctggtgattctttccggccaggtcgccacctcattgattggctatgatgcctttcaggagtgcgacatggtggggatttcccgaccggtggtcaaacatagcttcctggtcaaacagacggaagatattcccctggtgcttaaaaaggccttctggctggcggcaagcggacgtcctgggccggtggtcgtggatctgccgaaagatattttgaatccggcgaaaaaaatgccgtatgtctggccggaaacggtcagtatgcgctcttacaatcccacaacatcaggacataaaggacaaattaagcgtgccttgcaaacgctggcgtcggcaaaaaagccggtggtctatgttgggggaggggcgataagcgcggcctgctatgcgccgctgcgccacatcattgaaacctttaacctgccggtggtctcttcattaatgggactgggcgcgtttcctgctactcatcgccagtcgttaggaatgctgggaatgcatggcacttatgaagccaatatgaccatgcataacgccgacgtgattttcgctgttggcgtacgatttgacgaccgcacgacgaataatctcgctaaatattgtccgaacgcgacggtattacacatcgacattgacccgacgtccatatccaaaacggttaacgctgatatcccggtggtgggcgatgcacgcctggtactggaacaaatgctggagctactggcgcaggatgcgccgtctcagccgcaggatgatattcgcgactggtggcagcagatagagagctggcgcgcccgtcagtgcctgaaatatgacgcggaaagcgaaagcattaaaccccaggcggtgattgaaactctctggcgtctgacgaagggtgatgcgtacgtgacgtccgatgtaggacaacaccagatgtttgccgccctctactacccgttcgataagccacgtcgctggattaactctggcgggctcggcacgatggggtttggcctaccggctgcactgggcgttaaaatggccctgccgaaagaaatggtggtctgcgtgaccggcgatggcagtatacagatgaacattcaggagctgtcgacagccttacagtatgaactgccggtactggttctgaacctgaacaaccgttacctggggatggtgaaacagtggcaggatatgatctattccggtcgccattctcagtcttatatgcagtcgttaccggattttgtgcgcctggcggaagcatatggccatgtcgggctgcagattaaccgtccggatgagctggaaagtaaactcagcgaagcccttgagcatgtgcgtaataaccgactggtgttcgtcgatgtcaccgttgatggcagcgagcatgtctatccgatgcagattcgcgggggcgggatggacgaaatgtggttaagcaaaacggagaggacctgatgatgcgccggattttatcggtattactggaaaacgaatctggggcgttatcgcgggttatcggcctcttttcgcaacgcggatataatattgaaagcctgaccgttgcgccgacagacgatccgacgttgtcgcgcatgactatccagacggtaggcgatgaaaaagtgcttgagcaaattgaaaagcaactgcacaagctggttgatgtgctgcgcgtcagcgagctgggacagggagcgcacgttgagcgggaaatcatgctggtgaaaatccaggccagcggctacggacgggaagaggtgaagcgtaatacggaaattttccgtggtcagattattgacgttacgccaacgttgtataccgttcaactggcgggcaccagcgataaactggatgcttttctggcctcgctgcgcgatgtggcgaaaattgttgaagtggcgcgttcaggcgtcgtcgggctttcgcgcggcgataaggttatgcgctgagcagattcgccggatgacgacgcgcttgcgttttatccggtctacaggctgatatctggcccaggtccgataagcgtagcgccatcaggcaggtttgccggatatcagccaacaggaattatcgcccaacccaatatcatcggttgggcttttttttgcgaaatccgtggtaacccggaataaaagcggttgccggagtgatcaaactgcgcttagatgttaacgattttaacccatgccgacataaaggttatggtttgtacaatttacacaaggggcaattgtgaaactggatgaaatcgctcggctggccggtgtctcgcgcacaactgcaagctacgttataaacggtaaagcaaagcaataccgcgtgagcgacaaaaccgtagaaaaagtcatggcggtagtgcgtgagcacaattaccatcctaacgctgtggctgccgggctgcgtgctggacgcacacgttccattggtctggtgatcccggaccttgaaaacacgagctacacccgtatcgcaaactatcttgagcgccaggcacgccagcgtggctaccaactgctgatcgcctgttctgaagatcagccggataacgaaatgcgctgcattgagcaccttttgcaacgccaggtggatgcaatcattgtttcaacttcgttaccgccggagcatcccttctatcagcgctgggccaacgatccgttccccatcgtcgcgctcgaccgcgcgctggatcgcgaacatttcaccagcgtggtcggcgccgatcaggatgatgccgagatgttggcggaagagctgcgtaaattcccggcggaaacggtgctttatttgggcgcgctgccggagttgtccgtcagtttcctgcgcgagcaggggttccgcaccgcatggaaagacgatccgcgggaggtgaatttcttatatgccaacagctatgagcgcgaagccgccgcgcagctgtttgagaaatggctggaaacgcatcctatgccgcaggcgctctttacgacatcattcgcgctattacagggcgtgatggacgttacgctgcggcgcgatggaaaactgccttcggatttagcgattgcgacctttggcgatcatgagctgctggattttctgcaatgcccggtactggcggtggcgcagcgtcatcgtgatgtcgcggaacgcgtgctggagattgtgctggcaagtcttgatgaaccgcgtaaaccgaaacccggcttaacgcgtattcggcgaaacctgtatcgtcgcggcattctgagccgtagctaaaggaccggcggtaaaagactctctcttctgccgccgtcaaacaaatgcgtatcagtaaaaatatcccttaaataattaagattattccttaaaattatccgaaaattcttttttattacctttcttttgtccgaaatcgtccatattccactaattaagacgtaacgagtcttttcctttgtattgttttgttacaagcaggcaagaaatcgtcgaattaacagccactttttgtctttggcgcgacagtcgcttgtaggcgctggtatagcaggcgccgcacacgttaaacaggcactgttaacacggtgcaatatgtcctaaaatgccgctcgcgtcgcaaactgacactttatatttttctcggattatattgagtccgttttaaacggcggtgggtctttggtttttttcttacaaatattcataacgttaatttggcttgcgcgctgggcggaaattaatcaacgcagatattcgccgtaaacattggcttttttacttcggtaagcgttgtgacttgcttgacaagcttttcctccgctccgtaaactccttcgagtgggaatttgtgggataaagtggtaagaaggggtgagactggcatgttccggggggcaacgttagtcaatctcgacagtaaagggcgcctgaccgtgccgacccgttatcgggagcaactgatcgagagcgctaccggtcaaatagtatgtaccattgacatccatcacccatgcctgctgctttaccccctgcctgaatgggaaattattgagcaaaagttatctcgtctgtcgagcatgaacccggtagaacgtcgcgtacagcgtttactgttgggccatgccagtgaatgtcagatggatggtgcaggtcgattactgatcgcgccagttctgcggcaacatgccggactgacgaaagaagtgatgctggttggacagttcaacaaatttgagctgtgggatgaaacgacctggtatcaacaggtcaaggaagatatcgacgctgaacagtcagctaccgaaacgttatcggagcggctgcaggacttgtctctataagatgatggaaaattttaaacacactacggtactgttggatgaagccgttaatgggctgaatattcgtccggatggtatctatattgatggcacatttggtcgcggcggccactcgcgcctgatcctctcgcaactgggcgaagaggggcgcttgctggcgatcgatcgcgatccgcaggcgatcgccgttgcgcagaccattaatgatcctcgcttctccatcattcatggacctttttccgcgctggctgattatgtcgccgagcgcgagcttaccggcaagattgacgggatccttctcgatcttggcgtctcttctccgcagcttgacgatgcggagcgcggtttttcatttatgcgcgacggtccgctggatatgcgaatggacccgacgcgcggccagtctgccgccgagtggttacaaacggcggaggaggcggatatcgcctgggtgctgaaaacattcggcgaggagcgttttgccaaacgtattgctcacgccattgttgagcgcaatcgcgaacagccgatgacccgcaccaaagagctggcggaagtggttgcggcggcgaccccggtaaaagacaaattcaaacatcccgcgacccgtaccttccaggcggtgcgcatctgggtaaacagtgaactggaggagatagagcaggcgctaaaaagctcgctcagcgtactggcctcaggcgggcggctttcaatcatcagtttccactcgctggaagaccgtattgtgaaacgctttatgcgtgagcaaagccgcggtccgcaggtaccggcgggattaccgatgacggaagcgcagctcaaaaaactgggcggtcgtgagttacgagcgttaggcaagttgatgccgggtgaaaaagaggtagctgaaaatcctcgggcccgtagttcagttctgcgtatcgcagagaggacgaacgcatgatcagcagagtgacagaagccctaagcaaagttaagggatcgataggaagcaacgagcgccatgccttgcctggcgtgatcggtgacgatcttttgcggttcgggaagctgccactctgcttgttcatttgcatcattttaacggcggtgacggtggtcacgacggcgcaccatactcgtttactcaccgctcagcgtgaacaactggttctggagcgcgatgcattggacattgaatggcgcaacctgatccttgaagaaaatgcgctcggcgatcacagccgggtagagcggatcgcaacggaaaagctgcaaatgcagcatgttgatccgtcccaagaaaatatcgtagtgcaaaaataaggataaacgcgacgcatgaaagcagcggcaaaaacgcaaaaatcgaagcgccaggaagaacagaccaacttcatcagttggcgttttgcgttgctgtgcggctgtattttactggcgctggtttttttacttggacgcgcggcgtggctacagattatcgccccggatatgctggtgcgtcagggcgatatgcgttcgctgcgtgttcaggaagtctccacctcacgcggtatgattaccgaccgttccgggcgtccactggcggtcagcgtaccggttaaggcgatctgggccgacccgaaagaagttcatgacgccggcggcatcagcgtcggcgatcgctggaaagcgctttctactgcgctcaatattccgctcgatcagctctccgcccgtatcaacgccaacccgaaagggcgttttatttatctggcgcgccaggtaaatcctgacatggcggactacatcaaaaaactcaaactgccggggattcatttgcgtgaagaatcacgccgctactacccgtcaggagaagtaaccgctcacctcatcggttttaccaacgttgacagtcaggggattgaaggcgttgaaaagagctttgataagtggcttaccggtcagcctggcgagcgaatcgtgcgtaaagaccgctatggccgcgtgattgaggatatctcctccactgacagtcaggcagcgcacaacctggcgttaagcattgatgaacgcttacaggcgctggtttaccgcgaactgaacaacgcggtggcgtttaacaaggcggaatccggtagcgcggtgctagtcgatgtcaataccggtgaagtactggcgatggcgaatagcccttcctataaccccaacaaccttgccggtacgccgaaagacgcgatgcgtaaccgtaccatcaccgacgtgtttgaaccgggttctacggttaagccgatggtggtgatgactgcgcttcagcgcggtatcgtcaacgaaaatacggtgttgaataccgttccataccgaattaacggccacgaaattaaagacgtggcgcgctacagcgaattaaccctgactggggttctacagaagtcgagtaacgtcggtgtatccaaactggcgttagcgatgccgtcctcagcgttagtagatacttactcacgttttgggctaggaaaggcgaccaatttggggttggtcggagaacgcagtggcttatatcctcaaaaacaacggtggtccgacatagagagggccaccttctctttcggctacgggctaatggtaacgccgttacagttagcgcgagtttatgcaacgatcggcagctatggcatttatcgcccgctgtcgattaccaaagttgatccgcctgtacccggcgaacgcatcttccctgaatccaccgtacgcaccgtggtgcatatgatggaaagcgtggcgctgccgggcggcggcggcgtgaaggcggcaattaaaggctaccgtatcgcgattaaaaccggtacggcgaaaaaagtggggccggacggtcgctacatcaacaaatacattgcttacaccgcaggcgtcgcgcctgcgagtcagccgcgcttcgcgctggtggttgtcatcaacgatccgcaggcgggtaaatactacggcggcgccgtttccgcgccggtatttggtgccatcatgggcggcgttctgcgcaccatgaacatcgaaccggacgcgctggcaacgggcgaaaaaaatgaattcgtaattaatcaaggcgagggaacaggtggcagatcgtaatttgcgcgaccttcttgctccgtgggtggctggactacccgcgcgagaactgcgagagatgacgctcgacagccgtgtggctgcggcgggcgatctctttgtggcagtggtgggtcatcaggcggacgggcgtcgttatatcccgcaggcgatagcgcaaggcgtagctgccattattgcagaggcgaaagacgaggcgagtgacggtgagattcgcgaaatgcacggcgtaccagtcgtctatctcagccagctcaatgagcgtttatctgcgctggcgggccgcttttaccatgagccatctgaaaacatgcgtctggtggcggtgaccggcaccaatggcaagaccaccaccacccaactactggcgcagtggagccagttgctcggcgaaaccagcgcagtgatggggacggtaggtaacggactgttgggtaaagtgatcccgacggagaacacaaccggttccgcagtggatgttcagcatgtgctggccagtctggttgcgcagggcgcgaccttcggcgctatggaagtctcttctcacggcctggtgcagcatcgcgtggcggcgctgaaatttgccgcctccgtgtttactaatttgagccgcgaccatctcgactatcatggcgatatggcgcattacgaggcggcaaaatggatgctttattccacccaccatcacggtcaggcaatcgtcaacgccgatgatgaagttggacgccgctggctggcgtcgctacccgatgcggtcgcggtttcaatggaagggcatatcaaccctaactgtcacggtcgttggctgaaagcggaggcggtggagtaccacgaccgcggagtgacgattcgttttgcttcaagctggggtgaaggcgaaatcgaaagctgcctgatgggcgcgtttaacgtcagcaacttactgctggcattggcgacgctgctggcgctgggctatccgttaacggatttgctgaaaaccgccgcgcgtttgcagccggtttgcgggcgtatggaagtgttcactgcgccaggcaaaccgacggtggtggtggattacgcgcacacgccggatgcgctggaaaaagcattgcaggcggcgcgcctgcactgcgccggaaaattgtggtgcgtctttggctgtggcggggatcgtgacaaaggtaagcgcccactcatgggggccattgccgaagaattcgcggatatcgtcgtggtgactgacgataacccgcgtaccgaggagccgcgcgccattatcaacgatattctggccggaatgctggacgccgggcaggtcagggtaatggaaggccgcgctgaggcggtaaccaatgccattatgcaggcaaaagacaatgacgtcgtgctgattgcaggtaaagggcacgaggattaccagattgtcggcacgcagcgtcttgattattcagaccgcgtgaccgcagcgcgtttgctgggggtgatcgcatgattagcgtaacgctcagcaaaattgccgatgtccttggcgccgaacaccgcggggcggatctcacgctcgatacggtcattaccgacacacggaaagtgacgccgggatgcctgttcgtggcgctgaaaggggaacgctttgatgcgcatgattttgctgataaagcaaaagcgaacggcgctggcgccctgctggtcagtcgtcctctggatatcgatcttccgcaggtgattgtaaaagacacgcgtcaggcatttggccaactggccgcctgggtacgtatgcaggtaccggcgcgggtggtggcgttaaccggttcgtccggcaaaacctcggtcaaagagatgaccgccgcgattcttagccagtgcggaaatactttgtataccgcaagcaattttaacaacgacatcggcgtgccgataacgctgctgcgcttaaaccatgattatgactatgcggtgatcgagttaggcgctaatcaccagggagaaatcgcctggaccgttagcctgacgcgcccggaagcggcgctggtcaataacctggcggcggcgcatctggaaggtttcggctcgctggccggcgtggcgaaagcgaaaggcgaaatctataccggtttgcctgagaacggtatcgcgattatgaatgccgataataatgactggctgaactggcaaagcattattggcgatcgtcaggtgtggcgcttttcgccgaatgcggcaaacagcgactttaccgctgcgaatatccacgtgacgtcacacggtaccgaatttaccctgcaaacgccgatgggcagcattgatgtgctgctgccgttgccggggcggcacaatattgccaacgcgctggcggccgctgctttatcaatggcggtgggggcgacgctggcggcggttaaagcagggctggcggcgttaaaagccgtacccgggcgtctgttcccgattcaactaagtgaaaaccaactggtactggatgacgcttataacgccaacgtcggttcgatgaccgccgcagtgcaggtcctttctgaaatgcccggctaccgcgtgctggtggtaggcgatatggccgagctgggcgcagaaagcgaagcgtgccacctccaggttggcgaggccgcaaaagcggcgggtattgatcgcgtgttaagcaccggaaaactcagtcaggttatcagccacgccagcggcgtcggcgaacattttgccgataaagccgcgctcattgcgcgtttacacgctctgcttcaggagcaaccgatgatgactattttagtgaaaggatcacgcagcgccgcgatggaagatgtggttcatgcgttacaggagaaaggttcatgttagtttggctggccgagcatttggtcaaatattattccggctttaacgtcttttcttatctgacgtttcgcgccatcgtcagcctgttgaccgcgctgttcatctctttatggatgggcccgcgtatgatcgctcgtctgcaaaaactctcttttggccaggtggtacgtaacgatggcccggaatcgcacttcagtaaacgcggtacgccgacgatgggcggcatcatgatcctgacggcgattgtgatttccgttctgttatgggcttacccgtctaacccgtacgtctggtgcgtgctggtggtattgatcggctacggcattatcggttttgtcgatgactaccgcaaagtggtgcggaaagataccaaagggctgattgcgcgctggaaatatttctggatgtcggttatcgcgctcggcgtggcctttgcgctttatctcgtcgggaaagacacgcccgcgacccaactggtggtgccgttctttaaagatgttatgccgcaattggggctgttttacattctgctgtcctactttgtcatcgtcggtacgggtaacgccgtaaacctgaccgacgggcttgatggtctggcgattatgccgactgtcttcgttgccgccggctttgcgctggtggcttgggcgaccgggaacatgaacttcgccaattacctgcatattccgtatttacgccatgcgggcgagctggtgattgtctgtacggcgattgtcggcgcgggattaggattcttgtggtttaacacctatccggcgcaggtttttatgggcgatgtcggatcgctggcgttgggcggcgcgttgggcattatcgccgtgctgctgcgtcaggaatttctgctggtgatcatgggcggcgtctttgtggtggaaactctgtcggtcatcctgcaggtgggttcctttaaactacgcggacagcgtattttccgtatggcgcctatccatcaccactatgaactgaaaggctggccggaaccgcgcgtgattgtgcgcttctggattatttcgctgatgctggtgctgattggcctggcaacgctgaaggtacgttaatcatggctgattaccaggacaaaaacgtcgtcattatcggtctgggcttaaccggactctcttgcgtggacttttttctcgcccgcggcgtgacgccgcgggtgatggatactcgcgtgacgccgccgggtctggataagctgccgcaagaggttgagcgtcacgttggcggcctgaacgacgagtggctcttagcggcggatttaatcgtcgccagccctggtattgctctggcgcatccctctcttagcgctgccgccagcgctggagtggaaattgtcggcgatatcgaactgttttgccgcgaagcgcaagcgccgattgtggccatcaccggctcgaacggcaaaagcaccgtgaccaccttagtgggcgagatggcgaaggcggcgggcgtcaatgtcggcgttggcggcaatatcggtcttccggcgctgatgctgctggatgccgatcgcgaattgtacgtgctggaattatccagtttccaattggaaactacctcaagtttgcaagcggcggcggcaacggtgctcaacgtcactgaagatcatatggaccggtatccgtttggtttgcaacagtaccgggcggcgaaactgcgcgtctacgagaaggcgaaagtgtgcgtagtgaatgccgatgacgcgttgacgatgccggtacgcggggccgatgagcgctgcgtcagctttggcgtcaatatgggtgattatcaccttaatcgtcagcagggcgaaacctggctacgagtcaaaggtgagaaggtgctgaacgtgaaagagatgaagctttccggtcagcataactataccaatgcgttagcggcgctggcgctggcggatgccgtaggtctgccgcgcgccagcagtttgaaggcgttgacgacatttaccggtctggcgcatcgcttccagctggcgttggagcataacggcgttcgttggatcaacgactcgaaagcgaccaatgtcggcagtaccgaagcggcgctaaacggtttgcatgtggacggtacgctgcatctgctgctgggcggcgacggtaagtcggcagacttttctccgctggcgcgctatctgaccggcgatcgtatccgcctgtattgctttgggcgcgatggcgcgcagcttgccgcactgcgtccggaaatcgcccaacagactgagacgatggaagaggcgatgcgtttgctggcgccgcacgttcagccgggtgatatggtgctgttgtcgcccgcctgcgccagcctcgatcagtttaaaaattttgagcaacggggcgatgtctttacccgtctggcgaaggagttaggttgatgcgtttatctctcccccgtctgagaatgccgcgcgtaccaggctttggcctcctggcctggctgtttgcggcgcttaaaggctgggtgatggcttcgcgcgataaagacgccgacagtctgatcatgtatgaccgcacgctgctatggctgaccttcgggctggcggcgattggttttgtcatggtgacgtcggcctccatgccagtcgggcagcgcctggcgaacgatccgtttttgtttgccaaacgtgatgcgctctatatcttcctggcattttgtctggcgatggtcacgctacgtttgcccatgaccttctggcaaaaatacagcacgacgatgctgattgcgtcgatcattatgctgcttatcgtgctggtcgtcgggagctcggttaacggggcgtcgcgctggattgcgctggggccgctgcgtattcagcctgcggagtttaccaagctgtcgctgttctgctacctcgcgaactatctggtgcgtaaggttgatgaagtgcgaaataacctgcgcggctttttaaaaccaatgggcgtgattctggtgctggcggtgttactgctggcacagcctgacctcgggacggtggtcgtactgtttgtcaccacgctggcgatgctgtttcttgccggggcgaaattatggcagttcatcgccattatcgggatgggcatctcggcggtgattctgttaatcctcgccgaaccgtatcgtattcgccgcgttacctcgttctggaacccctgggaagatccgttcggcagcggttatcagctgacgcagtcgctgatggcttttggtcgcggtgagatatgggggcaagggctggggaattcggtgcagaaactggagtatttgccggaggcgcacaccgatttcatcttcgccattattggggaagaactgggttatatcggtgtggtattggcgcttttaatggtatttttcgtcgcttttcgcgcgatgtcgattggccgtaaggcattggagattgaccaccgtttttccggatttttagcgtgttctatcggtatctggtttagttttcaggcgctggtaaacgttggcgcggccgcggggatgctgccgaccaaaggtcttacgctgccgctgatcagttatggcgggtcgagtctgttgattatgtcgacggccattatgtttttattacgtattgattatgaaacgcgtctggaaaaagcgcaggcgtttacacgaggttctcgatgagtggtcaaccgaagcggttaatggtgatggcgggcggtaccggcgggcacgtgttccccggactggccgttgcgcatcatttaatggcccagggctggcaggttcgctggctgggtacctccgatcgtatggaagcggatttagtgccgaagcatggcatcgatattgactttattcggatctccggtctgcgcggtaaaggcgtaaaagcgcttctggcggcgccgctgcggatttttaacgcctggcggcaggcgcgggcgatcatgaagcggtttaagccggatgtcgtgctgggaatgggcggttatgtttccggccccggcggtcttgccgcctggtcattgggtattccggtcgttttgcatgagcaaaacggtatcgccgggctaaccaatcagtggctggccaaaatcgcgaccacggtgatgcaggcgtttcccggtgcgttcccgaacgcggaagtggtgggtaacccggtgcgtaccgacgtactggcgttgccgttgccgcaggtgcgtctggccggtcgtgacggcccgattcgcgtgttggtggtcggcggttctcagggggcgcgagtcctgaaccagacgatgccgcaggttgccgccagactgggcgatacggttacaatctggcatcaaagcggaaaaggcgcgcagctcacggtagagcaggcatatgccggggcgggacaaccgcagcataaggtaacggaatttatcgatggcatggccgccgcctatgcgtgggcggatgtggtggtatgtcgttccggcgctttaacggtgagcgagatcgccgccgccgggttaccggcgatattcgtgccgtttcagcataaagacaggcagcagtactggaatgcgctgccgttagaaaacgccggcgcagctaagatttttgagcagccgcagtttactgtagaggctgtcgccgacaccctggcggggtggtcgcgcgaggcgttgttaaccatggcggagcgtgcccgcgcggtatccattccggatgctaccgagcgcgtcgccagtgaagtcagccgggttgcccggacataatttgtggcggtgccttttgcatcgcagggtttttctaccctcaataatttgggttgcaggcaagccaacgcatctgcaatttgaagtatggcgggtattggagttaatggcgtaaagaatgaatacacaacaactggcaaaactgcgttccatcgtgcccgaaatgcgtcgcgttcggcacattcactttgtcggcatcggtggtgctggtatgggcggtattgccgaagttctggccaatgaagggtatcagatcagtggttccgatttagcgccgaatccggtgacccagcagttgacgagcctgggggcgacgattttctttaaccatcgtccggaaaatgtgcgtgatgccagcgtggtcgtcgtttccagcgcaatttccgcggataacccggaaattgtcgcggcgcatgaagcgcgtattccggttattcgccgtgcggaaatgctggcggaactgatgcgttttcgccacggcatcgccattgccgggacgcacggaaaaaccacaacgaccgcgatggtgtccagtatttatgccgaagcggggctggacccgactttcgtgaatggcggattggtgaaagccgcaggcgttcatgcgcgtctgggccatagtcgttacctgattgccgaggcagatgagagcgacgcatccttcctgcatttgcagccgatggttgcgatcgtcaccaacatcgaagccgaccatatggatacctatcatggcgactttgaaaatttaaagcagacgtttattaacttcctgcataacctgccgttctacggtcgcgcggtaatgtgcgtcgacgatccggtcatccgcgagttgctgccgcgggtggggcgtcagaccacgacgtatggctttagcgaggatgctgacgtccgcgtagaagattatcagcagatagggccgcaggggcactttacgctgttgcgccagggaatgccggatctgcatgtcacgttgaatgcgccgggtcgccacaatgccctgaatgccgccgcggcagtggcggtagcgaccgaagaaggcatcgacgatgacgctatcctgcgcgcgctggaaagcttccaggggaccgggcgtcgttttgacttcctcggcgagttcccgcttgagccggtgaatggtaaagccgggacggcgatgctggtggatgactatggacatcatccgaccgaagtggacgccaccattaaagctgcgcgagcagggtggccggataaaaacctggtgatgctgtttcagccgcatcgttacacgcgcacgcgcgatctgtatgacgatttcgccaatgtgctgacccaggtcgatgcgctgctgatgctggacgtttacccggcgggcgaagcgccgattccgggcgcggatagccgttctttatgtcgcacgattcgtaatcggggaaaaattgacccgattctggtttccgatccggctcaggttgcgacaatgttagcgccggtgctgacgggtaacgacttgatattagtgcaaggcgcaggaaatgttggcaaaattgcgcgttacttatctgaaatcaagctgaagccgcaaatccaggaggaagagcaacatggctgataaaatcgcggtcctgttgggcggaacctctgcggagcgggacgtttcgttaaattccggcgcggcagtgttggccgggttacgtgaaggcggtattgatgcgcatcccgtcgatccgcaagaggtcgatgtcgcgcagcttaaagcaatgggctttcagaaggtctttattgcgttgcatggccgcggcggtgaagatggcaccttacagggaatgcttgaactgctcggcctgccttataccggcagcggcgtgatggcctcggcgctttccatggataaactgcgcagtaaattgctgtggcagggcgcaggcttaccggttgcgccgtgggtcgcgctgacgcgcgctgagtttgaaaaaggccttagcgaagaacaaaaagcgcgaatttcggcgctgggtttaccgctgatcgtcaaacccagccgtgaaggctccagcgtcggtatgacgaaagtagtagaagaaaatgctttacagggtgcgttatcattggcttttcagcatgatgacgaaatactgattgagaaatggctgtgcggtccggaatttacggtggcgatagttggcgaagaaattttaccgtcaattcgtatccaaccggcaggaaccttctatgattatgaggcgaagtatctctctgatgagactcagtatttctgccctgccggtttagaagcgtcccaggaagccgcgctacagtctctcgtcctgcaggcatggaaagctttaggctgcacgggatgggggcgtattgacgtcatgctggacagcgatggtcagttttatctgctggaagccaatacttctccggggatgaccagccatagtctggtgccgatggcggcgcgtcaggcgggaatgagcttctcgcagttagtggtacgaattctggagttggcggactgatatgtcgcaggctgcgctgaacacgcgaaacagtgatgaagagacgccttcttcacgccgcaataatggaacgcgtcttgcaggaatattattcctgctgacggtactgtgcaccgtgtttgttagcgggtgggtcgtgttagggtggatggaagatgcgcagcgtttaccgttatcaaagctggtattaaccggcgagcgtcactacacgcgtaacgatgatatccgtcaggcgatactggctctgggcgcgccgggaaccttcatgacgcaggatgtgaacattatccagagccagattgagcgtttgccgtggattaaacaggccagcgtcagaaaacagtggcctgatgaattgaagattcatctggttgaatatgtgccgattgcgcgttggaatgatcaacatatggtcgatgctgaagggaacaccttcagcgtgccgtcagaccgcatcggcaaacaggttttacccatgttgtacggcccggaaggcagcgcgagtgaagtgttgcagggataccgcgagatggggcaggtgctggctaaggataaattcactctaaaggaagcggcgatgaccgcacgtcgctcctggcaattgacgcttaataacggcattaagctcaatctcggcaggggcgatacgatgaaaaggttggctcgctttgtagaactctatccggttttacagcagcaggcgcaaaccgatggcaaacggattagctacgttgatttgcgttatgactcaggtgcggcagttggctgggcgccgctcccccctgaggaatctaatcagcaacagaatcaggcacaggcagaacaacaatgatcaaggcgacggacagaaaactggtagtaggactggagattggcaccgcgaaggttgccgctttagtaggggaagttctgcccgacggtatggtcaatatcattggcgtgggcagttgcccatcgcggggtatggataaaggcggggtgaatgaccttgagtcagtggtgaaatgcgttcagcgcgccattgaccaggcggaattgatggctgattgccagatctcctcggtatatctggcgctttccggcaaacatattagctgtcagaatgaaattggtatggtgcccatttccgaagaggaagtgacgcaggaagatgtggaaaacgtcgtgcatactgcgaagtcagtgcgcgtgcgcgatgaacatcgcgtgctgcatgtgattcctcaggagtacgccattgactaccaggaaggcattaaaaatccggtcggtctttccggcgtgcgtatgcaggcgaaagtacatttgattacctgccacaacgatatggcaaaaaacattgtcaaagctgttgaacgttgtggtctgaaagttgaccaactgatatttgccggactggcggccagttattccgtgttaacggaagatgaacgtgaactgggcgtctgtgtcgtggatatcggcggtggtacaatggatatcgccgtttatactggcggcgcgctgcgtcataccaaagtgatcccttacgcggggaacgtggtgaccagcgatatcgcttatgcctttggtacgccgccgagcgatgctgaagccattaaagttcgccacggttgcgcgctgggttccattgtcggtaaagacgaaagcgttgaagtaccgagcgtaggcgggcgtccgccgcgcagcctgcaacgtcagacgctggcggaagtgattgagccgcgttacaccgagctgctcaatctggtcaacgaagagatattgcaattacaggaacagcttcgccaacaaggggtaaaacatcacctggcggcgggcattgtgttaaccggcggcgcggcgcaaatcgaagggcttgctgcttgcgctcagcgcgtgtttcatacgcaggtgcgtatcggcgcgccgctgaatatcaccggtctgacggattatgcccaggagccgtattactcaacggcggtgggattgcttcactacgggaaagagtcccacttaaacggtgaagcagaagtggaaaaacgtgttacggcatcagttggctcgtggatcaagcgacttaatagctggctgcgaaaagagttttaatttttatgaggccgccagatattacggcctcaggcgacaggcacatgacggagagagattatgtttgaacctatggaactaaccaacgacgcggtgattacagtcatcggcgtcggtggtggcggcggtaacgctgttgaacacatggtgcgcgagcgcatcgaaggtgttgaattcttcgcggtgaataccgacgcgcaggcgttgcgtaagacggcggttggccagaccattcaaattggtagcggcattaccaaaggtctgggcgccggcgctaacccggaagtcggccgtaatgcggcggacgaagaccgtgaagcgctgcgtgcggcgcttgaaggcgcagacatggtatttatcgcggcaggcatgggcggcggtaccggaaccggcgcggcgccagtggttgctgaagtggcaaaagatttaggtattctgaccgttgccgtggtgactaagcctttcaattttgaaggcaaaaagcgcatggcatttgcggagcaaggtatcaccgagctgtccaagcatgtggactcgttgatcaccatcccgaacgacaagctgctgaaagtgctgggccgtggcatctccctgctcgacgcgttcggcgcggctaacgacgtgctgaaaggcgcggttcagggtatcgcagagctgatcacccgcccgggcctgatgaacgtcgactttgctgacgtgcgtaccgtgatgtctgaaatgggctacgcaatgatgggctccggcgtggcgagcggtgaagaccgtgcggaagaagcggctgaaatggctatttcttctccgctgctggaagatatcgacctgtccggcgcgcgcggcgtgttggtcaacattacggcgggcttcgacctgcgtctggatgagttcgaaaccgtcggtaacaccatccgtgcctttgcgtcggataacgccaccgtggttatcggtacctctctggacccggatatgaacgacgaactgcgcgtgaccgttgttgccactggaattggtatggacaagcgtcctgaaatcactctggtcaccaataaacaggtgcagcagccggtgttggatcgttatcagcagcacggtatggcgccgctgacgcaggagcaaaaaacggtcgcgaaagtggttaacgacaatgcgccacaggcggcgaaagagccggattatctggatatccccgcattcctgcgtaagcaagctgattaagaattagctggaatttgggattctgggctctttgtgctaaactggcccgccgaatgtatagtacacttcggttggataggtaatttggcgagattatacgatgatcaaacaaaggacacttaaacgtatcgttcaggcgactggcgtcggtttacacaccggcaaaaaagtcaccctgacattacgccctgcgccggccaataccggggtcatctatcgtcgcaccgacttgaatccaccggtagatttcccggccgatgccaaatctgtgcgtgataccatgctctgtacgtgtctggtgaatgagcatgatgtacggatttcaaccgttgagcacctgaacgctgctctggcgggcttaggtatcgataacatcgttattgaggttaatgccccggaaatcccgatcatggatggcagtgccgctccgtttgtctacctgctgcttgatgccggtattgatgcactgaactgcgccaaaaaattcgtacgcatcaaagagactgttcgggttgaagatggcgataaatgggctgaattcagaccgtacaatggttttacgttggatttcaccatcgactttaaccatccggcgatcgattccagcagccagcgctacgcgatgaacttctctgcggatgcgttcatgcgccagatcagccgtgcgcgtaccttcggttttatgcgtgatatcgaatatctgcagtcccgcggcctgtgcctgggcggcagcttcgattgtgccatcgttgttgacgattatcgcgtattgaacgaagacggcctgcgttttgaagatgaattcgttcgtcacaaaatgctcgacgcgatcggtgacttgttcatgtgtggtcacaatattattggtgcgtttaccgcgtataaatccggtcacgcattgaataacaaattgttacaggcagtcctggcaaaacaggaagcctgggaatttgtgaccttccaggacgacgcagaactgccgttggctttcaaagcgccttcgacggtactggcataacgacatacgctgtcgtataaaattcgactggttaacctggcactctctccggccaggcgagctagtcgttttttttttactatcctttatctgcgctttccttaatacagccattttgacagggttaaatggaaacacggcgcgttcgctgttttcttagccgattttcaccttagcttctcgtcattactgctgtagcgcgtacgctttaatgataagatttgtgcgcaaattgttttgattccgtaagcccatgaggggcatatcaggtggcaatgacgtgagtggaatactgacgcgctggcgacagttaggcagacgatacttctggccgcatctcttattagggatggtcgcggcgagttttggtttgcccgcgctcagtaacgccgctgaaaccaatacgcctgcaaggacgaccgccagcaccgcgtctaaagttaactttagccatcttgcgctgttagaagcctctaaccgtcgtcccaatttcaccgtagattactggcatcagcacgctattcgcacggtgattcgccacctttcttttgcaatggcgccgcaaacgctgcccgttgccgacgcgccgtcgccattacaggcgcatcatatcgccttactgaatacgctcagcgcgatgctcacgcaggagggcacgccgccggcgattgttcgccgcctctccctggcgtattttgcgccacaaaccgcatttagcatcccggcctggataagtcaggcgcagggtatccgcgccggtccgcaacgtctcagctaacgaaaaaagacccttttactttatttgtagctccgcggcgcggggcatttgagactttattatgctaatcaaattattaaccaaagtattcggtagccgtaacgatcgtacgctgcgtcgtatgcgtaaggccgtcagccttattaatgcgatggaaccggagatggaaaaactctccgatgacgaactgaaagcgaaaaccaacgaatttcgcgcccgtattggaaaaggcgaaagcgtagagagcctgattccggaagcgttcgcggtggtgcgtgaagccagtaaacgcgtctttgggatgcgtcacttcgacgttcagctattgggtggcatggtgctcaacgatcgttgtattgccgaaatgcgtactggtgaaggtaagacgctgaccgcaaccctgccagcctacctgaacgcgctgtccggcaaaggcgttcatgtggtgaccgtgaacgactatctggcgcagcgtgacgccgaaaacaaccgtccgctattcgaattcctcggtatgtccgttggtatcaacctgccaggtatgcctgcgccagccaaacgtgaagcttacgctgccgacatcacttacggcactaacaacgaatacggttttgactacctgcgcgacaacatggcgttcagcccggaagagcgcgtgcagcgtaaactgcattatgcgctggtggatgaggttgactccatcctgatcgatgaagcgcgtacgccgctgattatttccggcccggcggaagatagctcggaaatgtacaaaaaagtgaacaaaatcattccgcacctgattcgtcaggagaaagaagattctgacactttccagggcgaaggccacttctccgttgatgagaaagcgcgccaggttaacctgaccgaacgcggtctggtgctgatcgaagagctactggtgcaagaaggcattatggatgaaggcgagtcgctctactcgcctggcaatattatgttgatgcatcacgtcaccgccgcgctgcgcgcgcacgcgctgtttacccgtgacgtggattacattgtgaaagacggcgaagtcatcattgttgatgaacataccggtcgtaccatgcaggggcgtcgctggtctgacggtctgcaccaggcggtagaagcgaaagaaggcgttgaaattcagaatgaaaaccagacgctggcgtctattaccttccagaactacttccgtctgtatgaaaagctggccggtatgaccggtacggcggatactgaagccttcgaatttagttctatctataagctggacaccgtcgttgttccgaccaaccgtccgatgatccgtaaagatttgccggatctggtctacataaccgaagcggaaaaaatccaggccattatcgaagatattaaagaacgtaccgcgaacggtcagccagtgctggtcgggacgatttctatcgagaaatctgaagtggtctccagagagctgaccaaagcgggcatcaaacataacgtactgaacgcaaaattccacgccaacgaagcaggcatcgttgcgcaggctggttatccagcggcggtcactatcgctaccaacatggcgggtcgtggtaccgatattatgctgggcggtagctggcaggcggaagtcgctgcgctggaagcgccgacggaagaacagattgcgcagattaaagcggactggcaggtacgccatgacgcggttctggctgccggcggcctgcatatcattggcaccgagcgccatgaatcccgccgtatcgacaaccagctgcgtggccgttccggtcgccagggcgatccgggttcttcccgtttctacctgtcgatggaagatgcgctgatgcgtattttcgcctccgatcgtgtctccggtatgatgcgtaaactgggaatgaagccgggcgaagcgattgagcacccgtgggtgacgaaagctatcgctaacgcgcagcgtaaagtagaaagccgtaacttcgatattcgtaagcaactgctggaatatgatgatgtggcgaacgatcagcgccgtgcaatttatacccagcgtaacgaactgctggatgtgtctgacgtgagcgacaccattaacagcattcgcgaagatgtctttaaggcgactatcgacgcctacattccgccgcagtcgctggaagagatgtgggatatcccgggtttgcaggaacgcctgaaaaacgacttcgacctggagatgccgattgccgaatggctggataaagagccggagctgcatgaggagacgctgcgtgagcgcatcctggcgcagtccatcgaggtgtatcagcgtaaagaagaggtggttggcgctgaaatgatgcgtcatttcgaaaaaggcgtgatgctgcaaacgctcgattccctgtggaaagagcatttggcggcgatggattacctgcgtcagggtattcatctgcgcggctatgcgcaaaaagatccgaagcaggaatacaagcgcgaatccttcgctatgttcgccgcgatgctggaatcgctgaaatatgaagtgatcagtaccctgagcaaagtccaggtacgtatgccggaagaggtcgaagcgatggaaatgcagcgtcgcgaagaggcggagcgcttggcgcagatgcagcagctaagccatcaggatgacgatgccgccgtggctgccgatctggccgcccaaaccggcgaacgtaagattggacgtaacgatccttgcccttgtggttccggtaagaaatacaaacagtgtcacggtcgcctgagctgatgcgataaacttaccggcctgataagacataatgtgttgccatcaggtcggtcggtgctggcattattgccgaagggcgctacgcttattcggcctagcattgaacacagataaaaaggcgcaggcgactgcgccttttttatggatgcaccaagatgaaaaaactgcaaatcgcggttgggattatccgcaacccgaacgacgaaatttttattacccgacgcgccgctgatgcgcatatggcgaacaagctggaatttcccggcggaaaaattgaagccggcgaaacaccagagcaggcgttgatccgggagctacaggaagaggtggggattacgccaacacaggtgacattattcgacactctggaatatcaattcccggatagacacattacgctgtggttttggctggttgaacgctgggagggcgaaccgtgggggaaagaaggacagccgggacggtggatcgcgcaaaacgcgttgaatacggacgattttccgccggccaatgaaccgattattcgtaaattacgccaatttgcgccttagtgggggatcgcaacacgatccccatcgatcttattagcgatttaatgtcgacataatttccggccagtagcgggggccggctgcggcgtcgtgaggaaaaaccgcctcaattgccgccagctcctgcgggcttagggtcagtgataacgcgccgaggttttcatccaccctggcgcagtggcgggtgccgggaatgggaacgaggtgcctgttgcgggccagcagccaggccagcgctaattgtgcgggggtacactctttttcgcgtgccatttgttttattgcttcagccagacgtaaattgcgcgagaagttctcacccatgaatctgggatttgtgcgacggaagtcattcgcagcaaaatcttctggcgttttaatcgtaccggtcagaaatccgcgtcccagcgggctgtaagcgacgaatcctatacccaaccgttcacaggtggaaagtgctgaaatttccgcttcgcgggaccaaagcgaatactcactttgcagcgcggtaatagggtgaacgttatgggcgcgttccagcgtttgcgttgatgcttcggatagcccgagataacgcacttttccctcgcgcaccaggtccgccattgcaccgacagtctcttctatgggaactgatggatcaacgcgatgttgatagtacagatcgatatgatcgacccccaggcgttgcaggctttgctcacaactacggcgaacgtactccggtctgccattgacgccacgcgccatagggttagcagggtcgagaacgataccaaatttcgtcgctaaaaatacccgatcgcgacgatcggcgatggctcttccgactaacctttcattggtataagggccatacatatctgcggtatcgagcagtgttaccccctgatctaacgcataatgtagcgtcttaattgaggtgctgtcgtcatgagcgccgtaaaatgcgctcatgcccatacatcccagtccgatggctgacactcgcggtccgtttgcgcctaatgtacgatattgcatactgcctccatgaggatattttgtgcatggcaggcagtctatacctggcgtataagatgaaaaatagggggaataagcatggtttatgaaggctggcttaataatgcgtcatgatgtgatgtccgtattgcatgctttttgcatgattgctgaaaaccatagcttcacgcgggcagcggcgcagttacatatttccacgtcggcgttaagtcagaatatgcgtcaactggaggatgaacttggcgtgaaattattgaaccgaaccacccggcgtgtcggtttgacagaagcaggacatgcctttcttgccagtatcagacccgcattgaaccatattgatgaggcgatggaacatgcctgccagagccgcgatatacccggagggacattacgcctgaccgtaccgcgcacggcggccacgcttctgttacaacctaatctcgccggcttcatgcgcgattatcccgatattcggctggatatcgatgtgaatgacggttttgtggatttaattaacgaacgctttgatgccggtattcgctttggcgatgcggtacaacttgatatgaatgtcgttccgctcggtgatgttttacgcccggcgatcgtagcatcccctgcataccttgcgcgttttggcacgccgctgcatcctcaggagctcatcaatcaccgctgcctttgccatcgttttacgcgtgagagcgggctatatcggtgggagtttgttcatggagcgcaacggctggaaattacgccggaagccgcgttaatggtgaatgataaagcgttgcgtctctccgccgcgcgtgatggggcagagctaacctacgtttttgaacaggatgtccacgaagacttacaggatgggcggttgtgttccgtacttgaggagtggctgcctgcggcggaccggttttatttgtattatcccggccgcgcgcatatggcgccaaaactacgcgtatttattgattatttttgtcataaggcgatattgccgtctcaacagagctatcaccgttagcgctcttcgctccagtcgtcgctatcagactggtcgccgctgctggcgattcgtttctcttcggcggcccattcgcccaaatcaattaactgacagcgtttagaacaaaatgggcggaaggggctaatttccccccagacgaccggtttaccgcaggtcggacagtttacgacggtcacgtcagacatttttactccttagcaacaggccagttcaaaatcaagacgctccggcaccagaccattttcactatccagcggcataaagcgaatggcaaaacggctcttatggccggaaatttgcggataaagttgtgaatcgagcgtcagcataagacgcagcaaatcggcgtcgtccccgttatcctgataaaaaccgttcaggctggtttgcttacggaaaggcgctgaattacggatcagatcaagcaccagcgtcagcgcctgggtgaggggattcaggctggcaagccagctttcaatctgggcatcgcgctgcgcctgttgtaggtgcaaccagatatgcagagtgggtaaatcgaaactgcaacagccgccaggaatacttaagcgttgacgcacaagagcaatcaagcgatcttcgcgtagctgctggccaatcctcggggcggagatcagcacgctgcccgccgattttaactgctggcgcagggcttcaatacggtcttgatcgacgccgggaacctcaacccaggcctgtaatttacgctgctggcgctccagttctttcagcagttcggtacggacttcgccccgttcgaacacatccagtagatcgctgatattacggaaaaaatgcagtgcgccagcatggtctgcaattggcaggttgatggagagctgttggatcaaaaactctatgcgcagccacgtacgcatcttctcattgagagggtgttcaaataggacctgggtgtgcattacggtttttcctgtgagacaaactgcgacgcgagcttaagataactggcgtgcaggcgggccacatctgatgcgatagcatccggtgcgccgttattatcaataacatcgtccgccacggcaaggcgcgcttcacgcgtcgcctgcgcagcgagaatgtgttcaacatgctcgcgcgtaacatcatcacgctgcattgtgcgtatgagctgcgtttcgggcgtaacgtcaaccaccagtacgcggttggctttttgatacaacctgttttcaaccagcagaggcacaacccataacacatagggcgacgtagcctgttgaaactgtcgttgggtttcctgctgaattaagggatgaagcagagcgttaagccaggctttttcttccggatgcgaaaaaatacgctcacgcagtgcccggcgacgtaacgtgccgtcggcggcgataagttcagaaccaaaatgttccgctattgcgttcagggcgggctgccctggctcaaccatctggcgcgcgataatatccgcgtcgatgacggttattccgaggtcagcgaaggcatcagcgacggtacttttaccgctgccaataccgccggttaaggctacggtatacctcatatctccagcttccggaattttagtttgataatcaaaaggttaaattttaaacatacaaagacgatatgctctgagcattaacctactattcgccaggtaaatttatgggattgtaacgtaaaaaaagagaatttctgagtcttgtacggccatgattagtgcgtatgatagcgtcactggagttgtgagtttcgatttttcgccattaacctcaggaatccgcacatgcgtattgaagaagatctgaagttaggtttcaaagacgttcttatccgtcctaagcgttctaccctcaaaagccgttccgatgtcgaactggaacgtcaattcacctttaaacactcaggtcagacctggtctggcgtaccgattatcgcggccaatatggataccgtcgggacgtttgaaatggcgcaagcgttggccgggtttgatattctgaccgctgtacataaacattatagcgttgaagagtgggcagcttttatcaacacggcttcggctgatgttctcaagcatgtgatggtttccaccgggacctctgatgctgatttcgaaaaaaccgtgcagattctggcgctgaatcctgcgctgaactttgtctgtattgatgtggccaatggctattcagaacattttgtgcagttcgtcgcaaaagcgcgtgaagcatggccgtcaaaaacaatctgcgcaggcaatgtggtaacgggcgagatgtgcgaagagcttatcctctccggcgccgatatcgtgaaagtgggaattggtcccggctccgtatgcacgacgcgtgtaaaaaccggcgtcggttatccgcaactgtcggcggttatcgaatgtgctgacgcggcgcatggcctgggcggcatgatcgtcagcgatggcggctgcaccatgccaggcgacgtagcaaaagccttcggcggcggcgcggatttcgttatgttgggcggtatgctggcgggtcacgaagagagcggcggcagcgtggtagaagagaatggcgagaaattcatgctgttctacggcatgagttcggaatctgcgatgaaccgtcatgtcggcggcgttgcgaaataccgcgcggcagaaggtaaaacggttaaattgccactgcgtgggccggtgggcaataccgcccgcgatatcctgggcggtctacgctcagcctgcacttatgtcggcgcgtctcgcctgaaagagttgaccaaacgcaccacctttattcgggtgcaggaacaagaaaaccgcattttcaatagcctctaatattctggctggcgtaaatgtgcgccagccttatcccatcccgctcatcgcgtctcccaaatgaaaaatcggcaaatacatcgccaccaccagcgtaccgataattaagccggtgatgatcaataacgccggttccaacagcgacgccagattatcggccagcgccagcgtagattcactgtggtgacgggcaaggttatgcagcatgatatcgagtgaaccggacgcttcgcccgttctgaccagttgcaggcatagcggactaaattcctgggtattttttagcgccaaccagaccggattgcccgcggcgatctcctgatgtacctgcgttaaacgctgtgaccagtaagggcagccgagactatcgatagcgctttccagtccctgaagaaaaggaatgcctgcgctttgggttaatgccagtacggtgaatatttgcgctagtttctggcctcttatcaggcgacccataacgggaagccgtagcagaagacgctgccgctgcgcttgccaggacggtttttgttttaacctgcggtgagcgatagcaacgagcatcgtcaggaacaagatgagccaaccccatgccggcccccattgcgctatcgcgataataccgcgtgtcagaagaggaagcggggtattgaagctacggtaaatggcggcaaattccggcaggacaaagtgcagcatggcgaaaacgaccagggcggccattgttagaataatggcgggatagcgcagcgcctttttcacgctaaccgtaatctgccgttgcgctttttgctgacgggccagttcaaagcagcattcggccagtttgccggtcagttctccggtgcggatcatcgtctggtagagcggcggaaatacctgcggccaggagactaatgcgctggaaaaagggacgccctgttcaagctcgtgagccagcgtgcgcaacagcgcttgccattgtcggtggggatgctgtttcgcaaggagttccagcccttcagaaagcgtcagtccggcatgaatgagcgtggccaactgatgaataatttcagcgctttgctcttctttccacagtgcggcgttaacgcttatgcgcttgatgcgaagcggcataatgcgctgatgttgcagggtgatgatcagcgccagacgattgtccacccatacaacgtcttgttccagttgacctttatcgttaacgccttgccagcgccagagctgtttaacgctcatggggcattcccagaacgcgcagtatctcttcaaaggacgtcatgccttgctcaacggcgcgacagccattttcaaaaagcgtccctgtaccggtctgctggaggtgggcttccagtgcttgcgccgatgcgccgctcgcaattaactgacgtaatgccggggtaacggttaacacttcgaataacgcggttcggccataaaagccgtggtagcaatgctgacagccgtttgcctgccagcgcggtagcgcgctgggccaaagattgggcgatagcaccacgggatcgctcagacgctgtttgcagtgcgggcaaagcttccttaccaggcgttgcgctaccaccagcgtaagcgccgatgagatcatccagcgtgttacgcctatttgctgcaaacgtatcagggtttcgctggtggagttcgtatggagtgttgaaagtaccagatggcccgtttgtgccgccttaatggcgatttctgcggtgtcgccgtcacgaatttcacctaccatgatgatgtcagggtcctggcgtaaaagcgcgcgcagcacattttgaaaggtgagcccggcgcggggatggatctgcgtctggttaatcccatccagtggaatttctatcggatcctcaacgctacagaggttgatacccggcgtattccgggtttgtagcgcgctgtatagcgtgaccgtttttccgctaccggtggggccagtcaccagtaccagcccctgaggttgctgtagggcttgtctaaaagcggtaagttgtgccccgtacatgcccagcgtgtccagatccagcgtttgttcaacctgatgcaacaaccgtaagacgactttttcgccttctttacagggaagcgtggcgatacgaaaagagatgctgtcgcccgtcaggtcaacggtaaattgcccgtcctgcggcagccgatgttcagcgatgtccaaatttcctaggactttcaatctggccgtcagcgcaagccccgtctctttggcgatgtcctgcagaatatgaagaacgccatcgatgcggagccttatccggtagcggctggcgccgggttcgagatggatatcagaggcgcgtttcgccatcgccgagcgtaatgtctgattgagaagctgggccgcggtttctccgcctttcgcggcgtttgtcgagggtgcctgatccggcttatgccgatgattttccatttgctggcgagtccagcacacaatatcaatctgtttttgcgtggcgaaatgcagagcgtccaataacgcatgagagggcgcgtcgaccaccgcaacagtgatactgttgctggcgctattgatcagtacagcctgatgacgttgacacaaggtgttgagctgagcgtctttcatcttgtctccttagttggcgtcaaaacggaagacatcttcacaagcctgttgtaacgcgctgtcgctttgaatattgcagttacgcgtccagccggtaatgccgttagcattgtcccaggcgggcgtcatgatgacgctaagcccgctcagactctcctgaccggtaagcgtgatgacgcctttttccacgctcatgcccgaaacataacgggtgatgacgggcgaggggataccgttgacgcccgcatcgcatgtgctcgtcccaccatgttccagagcgcagagttcgacggcagtacggtaggggacaaatgtttgcaacatatccgtcagcgccgctttacgcagatagttctggtaagccggaatgccaatggcgcttaaaatggcgatgatgccaataacgaccatcagttcgataagcgtgaaaccgcgttgtttttccattgttcgctccttgagttagccggcgctactgtggcaaacaagggaagagcgggcgagcggcaaaaggtaaaacgggaaggcggattctgaagattttcgctgcgttacatgacacggcaacgttattgcgaggcgctacgaatattttaccgaatcacgacgcggatctacggacaggtgatttatagacccgacggcgcagcgccatcgggcggagaggatcagcaaaaacgcatggagagatcgagcgcgcgcacgtgcttggtcagcgcgccaacggagatgaaatccaccccggtttcagcaaattcgcgtaaggtttccgcggtgacgttgccggatacttccagccgcgcctggccgttgacgtgtttcaccgcctcgcgcatctggtcggtgttgaaattatccagcatgatgatatccgcgcctgctttcagcgcatcgtccagttcatccagattttcgacctcgacttctaccggcacgtccggatgtagccagaacgctttttccaccgcctgacgaaccgaaccggaggcgatgatatggttttctttaatcaggaacgcgtcagtgagacccagacgatgattggcgccgccgccgcataaaaccgcatatttgagcgcggtgcgcagacccggcagcgttttacgcgtgtcgagcaactgggtttgggtgccagccaatagtccaacgtagcggcgtacttcactggcgacgccggaaagggtctggacaaagtttagcgccgtgcgctcgccggtcagcaatacgcgagcggggccgttcagttcaaacactgtttggttggcgtgaatggcgtcgccgtcatcgacatgccaggtgaggcgcacatcatcgcccgccagttggatgaagacctcttcaacccagcgcttgccgcagaaaacgccgtcttcacgagtgatcactgtggcatgggcttgcgtatctgccggcaaaagttgcgcggtgatatcgttgccagcatcgacttctccacctaaatcttcacgcagcgcctgagcaacggcggcagggatatcgagattaatgcgttccagtagcgcgtcacgtcggtcgtctgggttataacggcgaggcggcatgataaaactccaaattgctaacgaatcataaggtagaaacatgctactctgaagcagctataagcaccactcaaaaggagactccgcatgttgccagataagggttggttggtagaggcgcgacgcgtcccttctccgcattatgattgccgtccggatgacgaaaaaccgtccttgctggtggtgcataatattagcctgccccccggcgagtttggcggtccgtggatcgatgcattattcaccggaacgatagatccagacgcccatcctttttttgcagaaatcgctcatcttcgtgtttcggcccattgtctgattcgtcgcgacggtgaaatcgtccagtatgtgccttttgataagcgtgcgtggcatgcgggcgtatcaaactatcaggggcgggaacgttgtaatgatttctccattggtattgagctggaggggacggatacgctggcttataccgatgcgcagtatcagcagctagccgccgtgacgcgcacgcttatcgcttgctatccggcgatcgccgacaatatgaccggacactgcaacattgcgcctgaccgcaaaacggaccctggccctgcctttgactggccgcgctttcgcgctttggtagccctctcgtcgcacaaggagatgacatgacgctgtttacgacattactggtgctgattgtcgagcgcctgtttaagctgggcgagcactggcagctcgatcatcggctggaggcgctattccgtcggattacgcatttttcgatgttgcgcacgatgggaatgacggcgatcgcgatggtggtgacttttctactgctccaggcgttaaaagggctgctatttaacgtgccgacgctggtggtgtggattctcctgggcgtgctgtgtatcggcgcgggcaaagtgcgagtacattatcacgcctggctgaaagcggcgtcccgtaacgatccgcatccttgcgaggcgatggccagcgagcttacgctgattcacggcgtgccgccggattgtaatgagcgtgagtttttgcgtgagctgcaaaacgcgttgttatggataaatttccgtttttacctcgcaccgctattttggtttatcgttggcggtccgtgggggccggtaacgctggtgggctatgcgtttttacgggcctggcagacctggctggcgcgctatcagacgccgcaccaacgtttgcaatccggcattgacgctattcttcatgtactggactggattccggtacgtctggcgggcgtagtgtatgcattactggggcatggcgagaaagcgttgccggcctggtttgcctcgctggcggatctgcatacttcgcaatatcaggtgctcacacgtctggcgcagttctcactggtgcgcgaaccgcatactgacaaagtagaaacccccaaagcggcggtatcgatggcgaagaaggcctcgtttgtggtggtggtgattattgcgttgctcaccatttatggggcattagtgtaatgttgtgccgatagcgctaacgcttatgctgcctacaatggaaaaatctgtaggcccggtaagcgctagcgccaccgggcagtgcaacggcttagatcgtatcggctggcggcacgccaaaatcaggcatcccgttttcgtcccagcgcacccgtttcagacgcgtatggcggttgggatcgtacaacggatcgccttcaatttcggtgtaatttctcgcgtggtacaccagtacatcttcaccttccgacgtttgcgtaaagctgttgtgtcccggcccatactggcgattttcatagctggtggtaaagaccgggcgcggtgatttatgccagttggccggatcgcgcggatcgtcgtttacgttaatccacagtaaccccatacagtagttttcatcggtggcgctggccgaatagctgataaacagcttgtcgccatgcaccacgacggccggaccttcgttaacccaaaaaccccgacattcccagtcgtactctggcttactgagtcttaccggctcgcctttaagggtccacggattttccagttcagccagataaatatttgagttaccggcaatatccggcgctttttgcgcccacagataccactgttttccctgatgataaaaagtggtggcatcgagggagaaggtatcaaacggcgttttaatttgacccttctccgtccacttgccggtgagtgggtcggcatcggcgcactccagggcaaacatgcggtgctggaacattcccagtttatcaagcgcttgagtatgggtagcggcaaaatagatgtaccacttaccgttgatgcggtgcatttccggtgcccagatgagctggctcatcgggccgctttccggtttgcgccagacgacaacggggtcggcggcgcgcaacccttccagcgaatcagcccggcggatttccagcctgtcatattccggtacggaggcaataaagtagtaatcgctgccgtcgcgtaaaataaacggatcggcacgttgttcaataaacgggtttggccagtttgccatcaggctttccttacgctttcagcggctttgagctcctgcaactcactcaattcgcggtaattagtgcgacgtttttccaaatcgtcctggatttttttcatcagttcacggtcaactttcagcagacgtaccacgcctgcggtaatcagatagccaacgccaaggataacggtaaacaacagcataataccgttcatcgccgaggcgctttgcgctttggcgctggcgtcataaccgtaccaggagagcaaaaagccgaccatcgccccggcaatcgccaggcccagtttcaggaagaacagattaccggagaagctaataccggtaatgcgtttgccggttttccattcgccgtaatcatcgacgtccgccatcagcgaccagtgtaacggggaagggatctgatgcagaatattgagcaagaagtagagcgccactatcatcacggtggctttcgggtcaaagaaatagaacgcgcaggagaaaatcgccagcgcgatattggtccagaaaaataccttcaatttacaccagcgatcggttaagacttttgccagcatactgccgatcatcataccgaccacgccaagactaataaaaagcgtagcgaaatgggtgctttgtcccatcacccaggtgacgtaatacatggtcgccgccatacggataaaccccgggcagacgttacataaggtcaatagcagaatgcgtacccattgatcgtttttccacacatctttgaaatcattcttcatatcatcgtgcgtcggaacggcagggcgaacgcgttcgcggacgctggcaaagcagaacagaaacatacccatgccgataatcgccagcacggtcatcgccaactgatagcctttggctttgtcgccgtcgccaaaccagtccaccatcggcaatagcgttaacgatagcaacagcgtcgcgatgccgactaacacgaagcgataagcctgacaggctacgcgctcttttggatcgttagtgatcacgccgcccagtgagcaatagggaatattgatggcggtataggtcacggaaagcagaaaataggtgacgaaggcatagataactttgctgttatagccccagtccggcgtcgtgaacatcagaacgctgaacagcgcgtagggaaatgcaatccacagtagccaggggcggaaacgaccatatttactttgggtacgatcggcaagcgcgcccatcaccggatcggtaacggcatcgataacgcgtactgaaaggagtaaaacaccgactaacgctggggcaagaccaaaaatatccgtataaaagtaattaacaaacagcatgatagcgccaaaaataatgttatatccggcgtcacccatgccatacccgattttctctcttaccgaaagtctgcccttatccattgagacttctccccatcagatgatggcggtaattattcgcctgcgagcttttttttgcgtagcaggatcacgccgctgatatggataaaatggttatacgtgggaaactgtgaggcagataacaccctccccggacggggagggcggaaaagtaacgccacgatcagtgggctttcaccgtttttgccgttttttctttacacaggtagccgacgcccaggatgagcagccataccggaatcagccacacggagatcgccatacctggcgtcatcagcataatgatcaataccgccgccataaacagcaggcagagaacgttgccgaacggataaaacagggccgggaagcgggttttcacgccctgctgctgtttcgcgcgacggaacatcatatgggcaaggctaatcatcgcccagttaatgaccagcgcggagaccaccagcgccatcagcagtccgaatgcggactctggggccaggtagttgagcagcacgcacaacgccgtcacgacggcggaaaccaaaatggagctcaccggcacgccgcgtttgtcgacgttcagcagcgctttcggcgcatttccctgctgggccagaccgaacagcatacggctgttgcagtaaacgcagctgttataaaccgatagcgcggcggtgagaaccacgatattcagcgcattggcgacaaacgtatcgcccagctcatggaagataaggacaaacgggctggtatcggcggtgacgcgagtccatggcagcagcgaaagcagaaccgccagcgagccgatataaaaaatcaggatgcgatagataacctgattggtagctttggggatgctctgttccgggttatcggcttcagcggcggtgatccctaccagctccagtccgccgaacgaaaacataataatggccatcatcatcaccagcccggtccagccatgcggcagaaagccgccctgttcccacaggttgcgcacggtggcctgcggaccagcggtatcgctgaagagtaaccacgcgccgaacagaatcatagcgatgacggcgatcactttaataatggcgaaccaaaactccatctcaccgaacactttaacgttggtcaggttgatggcgttgataatcacaaagaaggctgccgcagaagcccaggtggggatctccggataccagaactggatatatttacccactgcggtcagttccgccatggcaactaatacgtacagcacccagtagttccagccggaagcgaatccggcaaagccgccccagtatttataggcgaagtggctaaaagagccggcgaccggttcttcaaccaccatctctcccagctggcgcataatcagaaaggcaataaagcctgcaatcgcatagcccaggataattcctggccccgccgactgaataacggaggcgcttcccaggaacaagcctgtccctatcgcgccgcccaatgcgataagctgaatatggcggtttttcaggccgcgcttgagctgctcgccgtgctgctgactgtccatcataaaacctcgtgtatcgggcgcggtttattcataacgcgcttattttgaacgatgcagtagtgcgtgtgtaagtttgcaattccgctttttgtattgatttatttacaagctcgttttttaaaatgtcacttcaactctttcgtcttgatcagaataatggtatgtggccgcgaatgcacctgctttgtgcaggggtgatgacgagttgcgtaaaaagaaagcacttgtaaatacctccttttattttcccttctaaaggttaatttgtttttattcattatttatgcataaaaatgcatttgatctgctgttgaatcggttcagatgagattttttatcgtttcaaatacgttaaatctacctcctggtgggtaaatttaacatttgtgcacagttacagttttgaaacgtgatttctgtaaaattgttaaaatgtgcctcctttactgatttcaatcaaaacctgtatggacagaaggtgaatactttgttactttagcgtcacagacatgaaattggtaagaccaattgactccgggcaaatggcttaagacaggaaatcatggcctacagcaaaatccgccaaccaaaactctccgatgtgatcgagcagcagctggagtttttaatccttgagggaacattgcgtcccggagaaaaactcccaccggaacgtgaactggcaaaacagttcgacgtctcccgtccctccttgcgcgaggcgattcaacgtctcgaagcgaagggattgttgcttcgtcgccagggcggcggaaccttcgtgcagagcagcctgtggcagagctttagcgacccgctggtggaactgctctccgatcaccctgaatcccagtttgacctgctcgaaacgcgccatgcgctggaaggcattgcggcttattacgcggcgctgcgcagcaccgacgaagataaagaccgtattcgcgagctgcaccacgctattgagctggcgcaagagtccggcgatctggatgccgagtccgaagccgtgctccagtatcaaatcgccgtcaccgaagcggcgcacaacgtggtattgcttcatctgctaaggtgtatggagccgatgctggcgcaaaacgtgcggcagaacttcgaattgctgtatgcgcgtcgggagatgctgccgctggtgagcacgcatcgcacccgtatatttgaagccattatggccggaaaaccagaagaagcgcgtgaagcgtcacaccgacatctggcgtttatcgaagagattatgctggacagaagccgtgaggagagccgtcgtgaacgcgctttacgccgcctggaacagcgcaagaattagttttttctggcagaacgttaaccagaagatgttgtgaataacgcgcaaaaatgtgcgcggcaactaaacgcagaacctgtcttattaagctttctgacgaaagtttaatgggacaggttccagataactcaacgtattagatagataaggaatacccccatgtcagaacgtttccaaaatgacgtggatccgatcgaaactcgcgactggctacaggcgatcgaatcggttatccgtgaagaaggtgttgagcgcgctcagtatctgattgaccaactgctttctgaagctcgtaaaggcggcgtgaaagtcgcggcaggcgcaggggccagtaattacatcaacactattgccgttgaagacgaaccggaatacccgggtaatctggagctggaacgtcgcattcgttctgcgatccgctggaacgccatcatgaccgtgctgcgcgcgtctaaaaaagaccttgagttgggcggccacatggcgtccttccagtcttccgccacgatctatgatgtctgttttaaccatttcttccgtgcgcgcaacgaacaggatggcggcgacctggtgtacttccagggccacatctctccgggcatctacgctcgcgcgttcttggaaggtcgtctgacccaggaacagatggataacttccgtcaggaagttcacggcaatggcctctcttcctatccgcacccgaaactgatgccggaattctggcagttcccgaccgtctctatggggctgggcccaatcggtgctatctaccaggcgaaattcctgaaatatctggaacaccgtggcctgaaagatacctctaaacagaccgtttacgccttcctcggcgacggcgagatggatgagccggaatccaaaggcgcgatcaccatcgccacccgtgaaaaactggacaacctggtttttgttatcaactgtaacctgcagcgtcttgacggcccggtcaccggtaacggcaagattgttaacgaactggaaggcatctttgcaggtgctggctggaacgttatcaaagtcatgtggggcggtcgttgggatgaactgctgcgtaaagacaccagcggtaaactgatccagctgatgaacgaaaccgttgacggcgactaccagaccttcaaatccaaagacggcgcttacgtgcgtgagcacttcttcggtaaatatccggaaaccgccgcgctggtggccgactggactgacgagcagatttgggcgctgaaccgtggtggtcacgatccgaagaaagtctacgcggcactgaaaaaagcgcaggaaaccaaaggcaaagcgaccgtaatcctggcccataccattaaaggttacggcatgggtgacaccgcggaaggtaaaaacatcgctcaccaggttaagaaaatgaacatggacggcgtgcgttacgtccgcgatcgtttcaacgtgccggttgccgatgctgatctcgaaaaactgccgtacattaccttcccggaaggttctgaagaacacaaatacctgcatgaacgccgtcaggcgctgcacggctacctgccaagccgtcagccgaacttcaccgagaagttagagctgcctcaactttcagatttcggcgcgctgctggaagagcaaagtaaagagatttccactacgatcgctttcgtgcgtgccctgaacgtgatgctgaagaacaagtcgatcaaagatcgtctggttccgatcatcgccgacgaagcgcgtactttcggtatggaaggtctgttccgtcagattggtatctacagcccgaacggccagcagtacaccccgcaggaccgtgagcaggttgcttactacaaagaagacgagaaaggccagattctgcaggaaggtatcaacgagctgggcgcaggcgcatcctggctggctgcggcgacctcttacagcaccaacgatctgccgatgatcccgttctacatctactactctatgttcgggttccagcgtatcggcgacctgtgctggcaggctggcgaccagcaggctcgcggcttcctgattggcgggacttccggtcgtactacgctgaacggcgaaggtctgcagcacgaagatggtcacagccacattcagtcgctgactatcccgaactgtatctcttacgacccggcttacgcttatgaagtggctgtcatcatgcatgatggtctggagcgtatgtacggtgaaaaacaagagaacgtttactactacatcaccaccctgaacgaaaactaccacatgccggcaatgccagcaggtgccgaggaaggtatccgtaaaggtatctacaaactcgaaaccctcgaaggtagcaaaggtaaagttcagctgctgggctccggttctatcctgcgtcacgtccgtgaagcggcagagatcctggcgaaagattacggcgtaggttctgacgtatatagcgtgacctccttcaccgaactggcgcgtgatggtcaggattgtgagcgctggaacatgctgcacccgctggaaaccccgcgcgtaccgtacatcgctcaggtgatgaacgacgctccggctgtggcatctactgactatatgaaactgttcgccgagcaggttcgtacttacgtaccggctgacgactatcgcgtactgggtacggatggcttcggtcgttccgacagccgtgagaacctgcgtcaccatttcgaagttgatgcttcttatgtggttgtcgcagcgctgggcgaactggctaaacgtggcgaaatcgacaagaaagtggtagcggatgcgattaccaaattcaacatcgatgcagataaagttaacccgcgtctggcgtaagaggtaaaagaataatggctatcgaaatcaaagtaccggacatcgggacagatgaagttgaaatcaccgagattctggtcaaagtgggcgacaaagttgaagctgaacagtcgctgatcaccgtagaaggcgacaaagcctctatggaagtcccgtctccgcaggctggcgtcgtgaaagagatcaaagtctctgtcggcgacaaaactgagaccggtgcacttatcatgattttcgattccgccgacggtgcagctgacgctgcgcctgctcaggcagaagagaagaaagaagcggcgccggcagcagcacctgctgcggcagcggcgaaagacgttcacgttccggatatcggcagtgacgaagttgaagtgactgaagtgatggtgaaagtgggcgacaccgtagaagctgaacagtcgctgatcaccgtcgaaggcgacaaggcctctatggaagttcctgctccgtttgcaggcaccgtgaaagagatcaaagtgaacaccggtgataaagtgtctaccggctctctgattatggtcttcgaagtggcgggtgaagcgggcgcagcagcaccagcgaaagcggaagccgctccggctgcggctgctccagcagcagcgacgggcgtgaaagacgttaacgtaccggacatcggcggcgacgaagttgaagtcaccgaagtgatggtcaaagtcggcgataaagttaccgctgaacagtcgctgatcaccgtggaaggcgacaaagcctctatggaagtgcctgcgccgttcgcgggcaccgtgaaagaaatcaaaatcagcaccggcgataaagtgaaaaccggctcgctgattatggtcttcgaagtggaaggcgcagcgcctgcggccgctccggctaaacaggaagcagcggcgccggctccggcggcgaaagctgagaagcctgctgccccggctgccaaagccgaaggcaaatctgagttcgctgaaaacgacgcttacgttcacgctaccccactgattcgccgtctggcgcgcgagtttggcgtcaacctggcgaaagtgaaaggcactggtcgtaaaggccgtattctgcgcgaagacgttcaggcttacgtgaaagacgctatcaaacgcgcggaagctgcgccggctgctgcgggcggcggtatcccgggtatgctgccgtggccgaaagtggacttcagcaagtttggtgaagttgaagaagtggaactgggccgtatccagaaaatctctggcgcgaacctgagccgtaactgggtgatgatcccgcacgttacgcacttcgacaaaaccgatatcaccgatctggaagcgttccgtaaacagcagaacgccgaagctgagaagcgcaaactggatgtgaaatacacgccagtggtcttcatcatgaaagcggttgccgctgctctggaacagatgccgcgcttcaacagctctctatccgaagacggtcagcgtctgaccctgaaaaaatacatcaacatcggcgtggcggttgataccccgaatggcctggtggttccggtctttaaagacgtgaataagaagagcgtgaccgagctgtctcgtgaactgaccaccatctccaaaaaagcgcgtgatggtaagctgaccgctggcgaaatgcagggtggttgcttcactatctccagcatcggcggcctgggaactacccactttgcgccgattgtcaacgcgccggaagtggctatcctcggcgtttctaagtcggcgatggaaccggtgtggaatgggaaagagtttgtgccgcgtctgatgatgcctatctctctttctttcgaccaccgtgtgatcgatggtgctgatggtgcgcgtttcattaccattatcaacaatatgttgtctgacattcgccgtctggtgatgtaagcgaaaaagccggcccgacggccggcttttttttgataatctcatggagtttgtgaggttattagcgaaagcgataattcgtgatccgtttgttgtttcaaaattgttaacaattttgtaagatacgggcggatagaacgacccggtggatgatgggcgatcaagtaccccggaccgccggatacaaataaagaggtcatgatgagtactgaaatcaaaactcaggtcgtggtacttggggcgggcccggcaggctattctgccgctttccgttgcgctgatttaggtctggaaaccgtaattgtagaacgctacaacacccttggcggtgtttgtctgaacgtcggctgtatcccttctaaagcgctgctgcacgtagcaaaagttatcgaagaagccaaagcgctggctgaacacggtatcgtcttcggcgagccgaaaaccgatatcgacaagattcgtacctggaaagagaaagtgatcacgcagctgaccggcggtctggctggtatggccaaaggccgtaaagtgaaagtggtcaatggtctgggtaaattcaccggggctaataccctggaagtggaaggcgaaaatggcaaaaccgtgatcaacttcgataacgcgatcatcgcggcgggttctcgtccgatccaattaccgtttattccgcatgaagacccgcgcgtatgggattctaccgacgctctggaactgaaagaagtgccgaagcgtatgctggtcatgggcggcggtatcatcggtctggaaatgggtaccgtataccacgcgctgggttcagagattgacgtggttgaaatgttcgaccaggttatcccggcggctgataaagacatcgttaaagtcttcaccaaacgcatcagcaagaaattcaacctgatgctggaaaccaaagtgactgccgttgaagcgaaagaagacggtatctacgtttcgatggaaggcaaaaaagccccggctgaagcgcagcgttatgatgcggttctggtggcgattggtcgtgtgccgaacggtaaaaacctcgacgcgggcaaagctggcgtggaagttgacgaccgtggctttatccgcgtcgacaaacagctgcgcaccaacgtgccgcacatcttcgctatcggcgatatcgtcggtcagccgatgctggcgcacaaaggcgttcacgaaggccacgttgccgctgaagttatcgccgggaagaaacactacttcgatccgaaagttatcccgtctatcgcgtacaccgagccagaagtggcatgggttggcctgaccgagaaagaagcgaaagaaaaaggcatcagctatgaaaccgccaccttcccgtgggcagcttctggccgtgctatcgcttctgactgcgcagacggtatgaccaaactgattttcgacaaagaatctcaccgcgtgatcggcggggcgattgtcggtaccaacggcggcgagctgctgggtgaaatcggtctggcgatcgaaatgggctgtgacgcggaagatatcgcgctgaccatccatgctcacccgactctgcatgagtccgtgggcctggcggcggaaatcttcgaaggtagcattaccgacctgccaaacccgaaagcgaagaagaaataatcttctgcgggtggcaatgcgccacccgatacagaaaagcggctttacagccgctttttttatgcatggcaaatcagatgtgtcaaatgatggcgaaggataacgaaaccgcaaaatttatcctttccgcagcagtacgtttttcaaagcttatgccgtcggtagtgcctttgtctgtcattttcgaccaactaattgtttcataagaaatacctctccttaatttgtcatcatcctgaaattggtaacgctataaaataatagcgagctaattatgaggtttgatatatgaaactttttctgacaacggcagcgctaactgcgaccttgatttccggcatggcatttgccagcgatcccgtcatcccctgggcgactaacagcggcggtacggaaagcacgcatattgcggcaatgggcgaggatttgaatgcgcagcatcagcagatcacccacacgcatgaaggcgtatgggcggccaattccggcagcattcaggctgatgaagccgcgctgaccagcaacaagccgccggtacaaggccacccggaattgatgccgcatcagggctaatgatcacggcctggcgataacgccaggcgcttacgggttattcggcgacctgccactgcgcgtctggcgcaaaacgcgtgatagcctgaactttactctccgtctccttgcctaaatccgcctgataaatacgatcgtcctggttgaccataaaactcatcaccccggtttcgccgtaatgcatcggccaggccagaagcgccgcaccgtgaccgtcgttatcgctgataatacggaaatggtagccgtggtaaccctcgtctggcgctgcgggactaaagtttgggcctaacggactggggacgtcgcctgctttggttggccagtacaggccatctttttggccttcgctactgattatcctgtgcgcccagcgatggttttgtaagtaatagtcctgctgcgcatcaacgtaagcatgcatggcctgtaaggtagaaagttcatttcgcccaatagtacgggtgaggatctcattcccggctgccgccatatcaaagcgccagccgccagtctctttcaccatgggcaccgggagctgccagtcttctcgtccgacattcaggtgcgccgtattgtctttttgtacaatgcgatggccttcgcgccagtcacgattgaagcgggccacggcctcgggatcggcaccttccggcggcagaaattgccgccagtcatcgcccagtagcgcggtaagctgcgtttcgttttttccggctaccgccgcggcgaaggcgctggcggccgcttccggggaggggaaccgttcctgcgcgtagcccagcaagggtaacgacagtaacagagcgcttaacataacctttttcattatctgctccggttaacggcgatgaaattcatgatgttcagaaaaatgttcccgcgcggcggcgcgttgctcggtgttcaagtgactgccgcgacggctttctaggccgcgtagctgttgcgattgccatgacggcgatcgactgtcgttcccgctaaacacattggcgtgcatattctggcgaaatgcctgacgctgctgtggcgtagaggattcaatacgctggcgggcggtgtctctctgctgttgtgaaacagggtgctgctgggctttagccttcagctcggaacgatgctgctgcgtggtggatttattcagtgtctgctgcgccgcctcgcgacgactgctgttttgtgttccgtcatagccacggtaattattacgctgggcaatttgatttaactgctgcgatgccgctttgcgctgtctgtcgcgggatgtctcgcctgacacgttagcgggtgatgtatggctgcgctgttggaattgcgccatggctgcctggcgctgactgtcgcgagacactggcgcttgctgcgttgcgcttaacccgccgctaacattggtgggatggaaccgttgcgcaacggtattattcggataggggacgccattgcgccaggcgggattatgctgccagcccatcgtttggcccggcaggttttgcccggatatccggttgaaattattgacattgatgttgatattatcgccattatgttgataaccgttaccaccatgatggtaatcatcatcatgatggtcgtcgtcatggtggtgatgatcgtcgtcatcccagtctatgctgctgaacaacgcataggtggtggcgacgcccagactataaccaaaacctttaacaaaactgtcggcaaactgctgccccggagggggcggtaaatacaccggcggataagcggtattgggccaggcgccatacaccgtcgtggggttatagtttggcacgtacaccacctgcggattcgcaggttcaattttgatgacggtcgacggtgttgctggcgtactggcggatgtggtggttgtcgtcgtgacggcggtagaagcgctggacttcggcacgctggtgacggtttgctgtggcgtggattttagcgaaccggtttgttgagcgagcagacgcagcctttgcaccgcatccatcacatcctgtggctgggctaagaacgcatcgcccaggttttgcacccattgcggattctcgcccataagcgccatcaactgaggaaaggcgaccagcgatttgacgctggggtcccacggttggctggccaccgcttgaatagcggcatcgccctgcagcgtggggttatcccgcgaccactggacggcctgaaccacgttcgccgggtaggtggaggccatgagcacctgcgaaagcagggcatcgggataaagcgcgacaggcgcgacccattgatcgatttgcgcagtggtaaaggtcgttttcgcgacaggcgcgggcacagcggtctgcgttggctcagaggtgggagctgccgcctgcgcgggcgcttcgggagcgcggcttttaacatacagtacgcccgaagcggcaaataacccggcactgcacacaagggcaatgagatggggtttaaagggcaacgtcattttatctctcccgattcccgagaatcgctatggtcattatgcctgccgccgacggggtgcagtttggcgtgagtataaagggacgatagtttaatttttagctaatgttgggatcggtaacgttacgtgacgatcaaagcacgaaatgaggtaagcatttatggctgcagctcccgtctcagtagagcattagaccatccttaacgattcagccacttttttatgttgcttttttgtaaacagattaacacttaaagaaaatcctgttattgtgccttatgcggtaccgggcatttaccctactaactactgtctcacaggagcgtgaagagaatcgcccatcaacaaaagcgccgcattatgacaatgagagcgaggagatatcgtcgtgctagaagaataccgtaagcacgtagctgagcgtgctgcccaggggattgtgccgaaacctttagacgcaacccaaatggctgcgcttgtcgagctgctgaagaccccgcctgtgggcgaagaagaattcctgttagacctgttgatcaaccgcgttcctcctggcgtcgatgaagccgcttatgttaaagccggttttctcgctgctgtcgcgaaaggcgacaccacctccccgctggtctccccagaaaaagccattgaactgctgggcaccatgcagggtggttacaacattcatccgctgattgacgcgctggacgatgcgaaactggcgccgattgcggccaaagcgctgtctcacaccctgctgatgttcgataacttctacgacgtagaagagaaagccaaagcgggcaatgaatatgccaaacaggtgatgcaatcttgggccgacgccgaatggttcctgagccgtccgccgctggcggaaaaaatcaccgtcaccgttttcaaagtgaccggcgaaacgaataccgacgatctctctccggcgccggatgcgtggtcgagaccggatatcccgttacatgcgcaggcgatgctgaaaaacgcccgtgaaggcattgagccggatcagccaggcgttgtcggcccgatcaaacaaatcgaagcattgcagaaaaaaggctacccgctggcctacgtgggtgacgtggtgggcaccggttcttcccgtaaatccgcgaccaactccgtgctgtggttcatgggcgatgacatcccgaacgtgccgaacaagcgcggcggcggtctgtgcctcggcggcaaaattgcgcctatcttctttaacaccatggaagatgcgggcgcgctgccgattgaagttgacgtttctaacctgaacatgggcgatgtaattgacgtctacccgtacaaaggcgaagtgcgcaatcatgaaaccgatgaactgctggcaaccttcgaactgaaaaccgacgtgctgatcgacgaagtacgcgccggtggccgtattccgctgattatcggacgtggcctgaccaccaaagcgcgtgaagcgctgggtctgccgcactctgacgttttccgtcaggcaaaagacgtggcagaaagcagccgtggcttctctctggcgcagaaaatggtcggtcgcgcctgcggcgtgaaaggcattcgtccgggcgcgtactgcgaaccgaaaatgacctccgtcggttctcaggatactactggcccgatgacccgtgatgagctgaaagacctggcctgtctgggattctccgccgatctggtcatgcagtcgttctgtcacaccgcagcctatccgaagcccgttgacgtcaccacgcaccacacgctgccggacttcattatgaaccgcggcggtgtctccctgcgtccgggcgacggcgtgatccactcctggctgaaccgtatgctgctgccggacaccgtcggtaccggcggtgactcccatacccgtttcccgattggtatctctttcccggcgggttctggtctggtggcgtttgccgccgcgaccggcgtgatgccgctggatatgccggaatcggtgctggtgcgcttcaaaggcaaaatgcagccgggcatcaccctgcgcgatctggtccatgccatcccgctgtacgccatcaaacagggcctgctgaccgttgagaagaaaggcaagaaaaacatcttctctggccgcatcctggaaatcgaaggtctgccggatctgaaagtcgagcaggcgtttgagctgaccgatgcttctgccgagcgttccgctgccggttgtaccatcaagctgaacaaagagccgatcgttgaatacctgacctccaacatcgtcctgctgaagtggatgatcgccgaaggctacggcgaccgtcgtacgctggaacgtcgtatccagggtatggaaaaatggctggcggacccgcagctgctggaagccgatgctgacgcggaatacgcagcggtgatcgacatcgatctggcggatatcaaagagccaatcctctgtgcgccgaacgatccggacgacgcgcgtctgctgtctgacgtgcagggcgagaagatcgacgaagtgttcatcggttcctgcatgaccaacatcggccacttccgcgcggctggtaagctgctggatagccacaaaggccagttgccaacccgcctgtgggtagcgccgccaacccgtatggacgctgcgcagctgaccgaagaaggttactacagcgtgtttggtaagagcggtgcgcgtatcgaaatcccgggttgttccctgtgtatgggtaaccaggcgcgtgtggctgacggcgcgacggtggtttccacttctacccgtaacttcccgaaccgtttaggtactggtgcgaacgtcttcctggcttctgcggagctggcggcggttgcagcgcttattggcaaactgccgacgccggaagagtaccagacctttgtggcgcaggtggataagacggcggtggatacctaccgttatctgaacttcgaccagctctctcagtacactgagaaagcggatggggtgattttccagactgcggtataatttgcctgacggcgtcaggcttaccatgcctacgcctcttattgcccggtggcggctacgcttaccgggcctacaaaacccatcgcaactgcggtgggtttttattttcattccgcctgctgttcccgctttttttcttctccgctgctgcgataatgactgtaagggctttgcagaggaacacattatggattacgaatttctgcgcgatgtgaccggacgggttttggtacgaatgtcgatgggccacgaggtggtcggtcactggtttaatgaagaggttaaagacaacctctcgctactggatgaagtagaacaagccgcgcgtacggtcaaaggcagcgaacgttcctggcaacgagcagggcatgagtacacgatctggatggacggcgaagaagtgatgattcgcgccaatcagctggatttttccggcgatgagatggaagaggggatgagttattacgatgaagagagtttatccctgtgcggcatggaggattttctgcgggtcgtcgccgcgtatcgggaattcgtcagtaaagcctgaccctctcttcgttattgccccgcaacgcctgtcgacggacagttgggggcggtagtggaaacgaaatcaccacacattccagccgggagtatcccggcttttttattgcagaatgattttttgatttttattaatcattttaaaactgtgatctgacgcgtttgtgatcttaatttgattgaatataatcgttatgattttattcaatcacaacaagcaacaggcggtaagaccatgaacatcaaaaaagcaatagagcgcgtacccggcggcatgatggtcgtaccgctcgttattggcgcagtcattaacaccttcgccccgcaggcgcttgagattggcggttttaccactgccttatttaaaaacggcgcggcgccgctgattggcgcttttctgctgtgtatgggagccggtatcagtgtgaaagccgcgccccaggcgttattgcagggcgggacgattacgctcactaagttgcttgtcgccatcggcattggcctgggcgtggagcatcttttcggcgcggagggtatttttggcctgagcggcgtggcgattatcgcggcgatgagcaattcgaatggcggactttatgctgcgttggtaggcgaattcggcaatgagcgcgacgtcggcgctatctctattttgtctcttaatgatggccctttctttacgatgattgcgctgggcgcggcagggatggcgaacattcccattatggcgctggtggcggtgctggttccgctggttgtcggcatgatcctcggcaatcttgatcctcatatgcgcgattttttgaccaaaggcggcccgctgctcattcctttctttgcttttgcgctgggggcgggcatcaacctggaaatgttactgcaaggcggacttgccggaattctgctcggcgtgctgacaacgttcgttggcggtttctttaatattcgcgcagatcgtctggttggcggaactggcattgccggggcggcggcctccagcactgcgggtaatgccgttgcgacgccgctggctattgcgcaggccgacccttcgctcgccgaggtggccgctgctgccgctccgctgattgccgcctcggtgatcaccacggcaatcctgacgccagtgttgacctcctgggttgcgaaaaaacaggcgcgtcaggcttctttggagaaaaacgcatgaaaatgatggttatcgccgatgattttaccggatcgaatgataccggcgtccagttggcgaagaagggggcgagaacggaagtcatgttgagcgcgtcgcaaaaaccgtcccgccgcgccgatgtgttagtcattaacaccgaaagccgggcgatgcccgcagatcaggcggcatctgccgtttatgccgcgctttccccgtggtgtgagacatcgccagcgccgctggtgtacaaaaaaatcgactccacatttcgcggcaatatcggcgccgaagtgacggcagctatgcgcgccagtcagcgaaaactggccgttatcgctgctgcgatccctgcggccggacgcacgacgcttgaaggaaaatgtctggttaatggcgccccgctactggaaaccgaatttgctagcgatccgaaaacgcccattgtctcttcccgtattgccgagatagtggcgttgcaaagtgagatccctgtgtatgaagtctttttacaggatgtccgacgcggcgggttaagcgccttacttacggcttatgcggctgagggcgaagggattatcgtcgtggatgcggtagaagagcgggacctgacgttgattgcgcaagcggcgtgcgaacaaccgtcgatgccgctgctcgtcggcgcagctggtctggcgaatgcgttgccggttgaactttttatgcaagaccggcagcggctaccggtactggtggtagccggttcgatgagcgaagccacgcgacgtcaggtggataatgcgctgtgccggggacgtgcggaggtcgtggatatcgatgccgcgcgcatggtgtcggatagcgcggagcaggaaatcgcgtctgtcgtagagcaggcctgcgcgctgttaagtcagcatcgacatacgattttacgcaccagccgtcgcgcagaagatcgacagttaatcgacgcgctgtgcgaaaaatccgcgatgagccgtcagcaattgggcgagcgactgagtcatcggcttggcgtcgtcacgttaaatattatcgagcaggcgcggattggcgggctgtttctgaccggcggcgatatcgctaccgccgtcgccggcgcgcttggcgctgaaggttatcgcattcagagcgaggtggcgccctgtattccctgtggaacgtttgtaaacagcgaaattgacgatctgccggtcattaccaaagcgggcggattcggttcagacagtacgttgtgtgacgcgctttattatattgaggagatgtattgtggagactaaaaccgttgccattaccatgggcgatccagcgggcattgggccggaaattattgttaaagcgctaagtgaagacggtctcaacggcgcgccgctggtggtgattggatgcctcgcaaccttgaaatgtttacaggcgaagggcatcacgccgaacgtcgagttacgggccattgaacgggtcgccgaagcgcgttttgcgcccggcatcattcatgtgattgatgagccgctggcgcagccggaggcgctggaggccgggaaagttcaggcgcaggcgggggatttagcgtatcgctgcgtgaagcgcgccaccgagttagcgttacggggcgacgtacaggctatcgctaccgcgccgctgaataaagaggcgctgcacctggcggggcacaactatccgggccataccgagctgctcgcgactctgacccatagccgcgattacgcgatggtactttacaccgataaactaaaagtgattcacgtttcaacgcatatcgcgctgcgtaaattccttgatacgttaagtaccacgcgtgtcgaaacggtgattggtattgctgatactttcctcaagcgtgtgggttacgttaaaccgcgtatcgccgtggcaggcgtgaatcctcatgcgggcgagaatggtctgtttggcgatgaagagacgcgtatcctgacgccagccattaccgatgcccgcgcaaaaggtatggacgtttatgggccgtgcccgccggatactgtatttctccaggcttatgagggacagtatgatatggtggtggcgatgtatcatgaccaggggcatatcccgttgaaattgcttggcttttatgatggcgtgaatatcaccgcagggctgccgtttatccggacctctgccgatcatggcaccgcatttgatatcgcctggacgggaaaagcaaaatctgagagcatggccgtatcgatcaaactggcaatgcaactggcataattccctgttatgaaaggacaacaccgtctggatctcattgtggcgtatctgaaaaaccatacgctggttacggtagaacagctggttgaggcggttgacgcatcgccagccactatccgtcgcgatttgatcaagctggatgagcagggcgtgatcagccgtagtcatggcggcgtggcgctgcggcgttttgaacccgcccagcccaccaccaatgaaaaacaactgcgatcgcccgctgaaaaacgggcgattgcacgcgttgccgcatcgctggtcaatgctggcgatgccgtcgtgctggatgccggtacgacaatgatggaactggcgaaatgcttaacccatcttccgctgcgggtcatcaccgtcgatctgcatattgcgctgtttttagctgagttccggcaaattgaagtgacgattgtcggcggtcgtatcgatgacagcagtcagtcctgtatcggtgagcatgggcgcaagctgttgcgcagcgtttatccgaacatcgcgtttatgagctgtaattcatggggggtaaaaacgggcgtgacgaccccaacggaagataaggccgggcttaaacaggagattattgctaatgcgcagcgcaaagtgttgctggcggacagcagtaagtatggcgcgcattcgctctttaatgtggtgccgcttgagcgctttaatgatgtgattaccgacgtcaatctgccgccgtcagcgcaggttgaactaaaagggcgcgcttttgcgctaacgctggtgcagccggagtgacagcgccgtcaggcgctgccagtggtgaatcagaccgcagaaatattgcggccgtagtaaatctcgcgcatctctttccacagcgcggcggtgatctgctggcgttcggtttcagtgagatcttccggtttggtgtgaaacatatagtgcttaagatcgaactctttaagcagcatcttggtatggaaaatattttcctgatacacgtttacatccaccatgtcatacagcgacttcatatcttccgacataaaattctgaatggaattaatctcatgatcgataaagtgtttcataccgttgacgtcgcgcgtaaagccgcgcacgcggtaatcgatggtgacgatatcagactctagctggtggatcaggtaattgagcgcttttagcggtgaaatcaccccgcaggttgacacttcgatgtcggcgcgaaaggtgcaaagcccgccttccggatggctttccggataggtatgcacacagatatggctcttatcgaggtgcgccaccacggtttccggcagcgggccgggatgttcggtttggtcgataagtttcgggtcgatcggctcttcgctcaccagaatcgtgacgctggcgccctggggttcataatcctgacgggcgatgttcaggatgttcgcgccgataatggagcaggtctccgacaggatctcggtcagtcggttggcgttatagagttcatcgatataggcgatatagccatcgcgctcttctgcggttttggcgtagcagatatcgtaaatacaaaaactcaggcttttcgtcagattgttaaagccatgcagtttcagctttttcaatttttatcacctccttaacgtcactgtgcggacagtgcgtcatgtagatattgcggtagcgcaaatgcagcggcatgaatagccgagttgtaatagcggcatttgaggccggcggcatgaaaacgcgcctgaataatttcgctcgacaggtggcgaagagcgtcgttgtccgtcgcccaggcgaaggtcataatgccgccgtaataggtcggaatcgccgcctggtagaagccgacatcgctgaagtaatgactcagcttgcggtggctgtcgagcgcttcatcctgttgcaggaagcacacgccgttctgggcgacaaaaatgccgcccggattcaggcaacgcttacagccttcataaaaggcggaggtaaacaggctttcgccggggcctatcggatcggtacagtcggaaatgatcacatcaaaggtctgatgggtctgattgacgaaattcacgccgtcgtcgatcaccagcgtaaagcgcggatcgtcgtagctgccggcattgtggttgggtaaatactggcggcaaaacgagactacgccagcgtctatctctaccatggtgatggtttcgacgtttttatgccgggtaacttcacgtagcattgcgccgtcgccgccgccgataatcagaacgtgtttcgcatgaccgtgcgccagcagcgggacatgggtcatcatttcatgataaataaactcgtcgcgttcggtggtctgtaccacgccgtccagcgccatcacgcggccaaaagcggcgttttcaaagatgattaaatcctggtgatcggttttttcatgatacagaacgttgtctacggcaaagtactgaccaaactggtcgtgtagcgtttcatgccacatcgtattttcggccattggctgatacctccattgttaacacccgtaaaaaaagggcgcaacatcatagctaacaatgaccgtggatgcacggtcattatttcagcaataggatcgcggaggattatttaacgtaggctaacaggctcagagaatcgcgggccagagctttgcattttttagcgaccggaataccgatgccgctaagatcgcggtagctgtcttcgcccaacgatttcatatcgaaggtgtcgtagttactcaggtcccactgattttgctgggcaaaaaagaccagcgcacggcgaatctgactgttgggtaaattttggtaaccacagtcatttttcagaaaaacgaaaaccgccgttaaatcggccatatcttcagcttcggattcagtaagcgcatagctatttgcgcataaggccatcaggctgccaaacaacacgggtctgaaaaacgtcttcattgcttctaccacggcatcagggaaagtcaacgttagcatactgagaacgtagcgacgacttttattatcaggattggtcgcggcgttttcattcttgttgtattgctgtcaggaacggtaaagacgtgttgctggcttgaccttcccgttagggcagggtctaagcttagacacccgcctgttcattataaggaaatgattatgttacgccgtgatttcttaaaatattcagtggcgctgggggttgcatcagcgctgccgctgtggagccgcgccgcttttgccgccgaacgtcccgcgttgcctattcctgacctgttaacggcagatgcgagcaaccgtatgcagttaattgttaaagccggacagtcgacattcgccggtaagaacgcgacaacctggggctacaacggtaatttgctggggccagcggtacagcttcacaaaggaaaaagcgtgaccgttgatatccataaccaactggccgaagacacgacgcttcactggcatggtctggagattccgggcatcgttgacggcggcccgcaggggattattcccgctggcggaacccgcacggtgacgtttacgccgcagcaacgcgccgcgacctgctggattcatccgcacaaacacggcaaaaccgggcgccaggtggcgatgggcctcgccggactggtgctgattgaagatgacgagattcgcaaattgcgcctgccgaaacagtggggtatcgacgatgtgccggtgatcattcaggacaaacgcttctccgccgatggccagattgattatcaactggatattatgaccgccgccgtcggctggtttggcgatacgctgctgaccaatggcgctatctatccgcagcattccgcgccgaaaggctggctacgtctgcgcttgctgaatggctgtaatgcgcgttcgctgaatatcgccgccagcgataatcgtccgctttatgtgatcgccagcgacggcggcctgctggcggagccggtgaaagtcaccgaactgccgttattaatgggcgagcgttttgaagtgctggtggatatcagcgacgggaaagcctttgatctggtgaccctgccggtcagccagatgggaatggcgatcgctccgtttgataaaccgcatccggtgatgcgtatccagccgctgcggattaccgcctccggtacgctgccggatacgttgacgacgatgccggcgctgccgtcgctggaagggctgacggtgcgcaacctgaaactgtcgatggacccgcgccttgatatgatggggatgcaaatgctgatgaagaaatatggcgctcaggcgatgagcggcatggatcatgacagcatgaacgcgcatatgcagggcggcaatatggggcatggcgagatggatcatggcaacatggatcacagcgggatgaatcatggcgcgatgggcaatatgaatcacggcggaaaattcgacttccataacgctaactttatcaacggccaggtcttcgatatgaacaaaccgatgttcgcggcgcaaaaaggccgacatgaacgttgggtgatttccggcgtgggtgacatgatgctgcatcctttccatattcacggcacccagttccgtattttgtcagagaacggcaaagcgccagcggcgcacagaacgggctggaaggatacggtacgcgttgagggcggtatcagcgaagtgctggtcaagttcgatcacgacgcgccgaaggaacatgcctatatggcgcactgtcatctgttagaacatgaagatacgggaatgatgttaggatttacggtctaatcgatgtctgtgacgcaggccgggtaaggcgaaaccgctacccggcacaatgcccggcatacgccgggcattaatggttatttcgcgtcgtcaggcaaagcataggccacgatatagtcgcccatcttcgtaccaaacgaaccgtggcctccggcagaaatgaccacgtactgcttaccgtttacctcataggtcatcggcgttgcctggcctccggcgggtaaacgtccctgccacagtttttccccgttgctcatgttataagcgcgcaggtagttgtcggcggtcgcggcaatgaacagcacgttaccggcggttgagattggcccgcccagcatgggcatccccatgttgaacggcaccggaaccggcatcgggaacggcatactgtcgcgcggcgtccctatacgtttcttccacacgatttcattggtcttcagatccaacgcggaaatgtagccccaggccggttgtttacacggcaaaccaaacggcgaaaggaacggattcagcgtgacgccgaacggtacgccgtactgcggctgaatacccgcttctgtaccggtacctttcgcgtctttcggcggttccattggattacccgggccgcgtgggatcagcttcgagacaaacggcagcgccatcgggttagcgatagcgacctgacggtctggatcgacggaaataccgccccattcaaacatccccaggttgccagggaataccaatgtcccctgctcggatggcggggtgaagataccttcatagcgcaactggtggaacataacgcggcacaccagttggtcgaacatggtcgcgccccacatatccgcgccggagagatcttttttcgggcggaaggttaaatcagagaacggctgagttttggcgacataatcgccttttgccgcgccctgcgggaccggtttttccggagcgggcacgaccagctcgccattacgtctgtccagcacaaagatattaccggttttcgctggtgcatagataaccggaacggtagtaccgtcaacggtaatatccgccagcgtcggctgtgccggcaggtccatatcccacagatcgtgatggacggtctgataactccaggccagtttcccggtggtggcattcagcgccaggatggagctggcataacgttcctgctccggcgtgcggttaccgccccagatatccggcgtggtcacgcccatcggcagatagaccagatccagtttcgcatcataggcggcaggggcccaggagttcggcgagttaaaggtaaaagcgtgctcatcggctggaatcgtgttcggatctttcgccccaggatcgaaggcccacagtagtttaccgctattaacatcaaaaccacggataacgccggacgtttcgcgagtagagaagttatccgtgaccgaaccggcaatgacaattgttttatcggtgataatcggcggcgacgtcggttcatacagtcccggcgtggtatccggcatattggtttgcagattcaggacgcctttgttggcgaaggtttcacacagcttgccggtttcggcattcaccgcgaaaaggcgaccgtcgttgaccgggaggataatgcggctcggacagtcggcgatgacctccggcgaggcggtatccgctttggcctcatgataagagacgccgcggcaggtcacatgctggaaagacgaatcggtcttcaactgaggatcaaaatgccacttctctttaccgctggcggcgtccagcgcgaacagacgctggtgagctgtacacagataaagcgtatcaccgacttttatcggggtcacttcgttggtgatttcacccggatcgttgggttgtttcagatcgccggtgcggaagacccacgcttctttcagttggtgaacgttatccgcagtgatctgtttcagcggcgaatagcgttggccttcctgattacgtccataggccggccagtcttcgtcggcgatcgacgaacttgttgcggcgggcgtggcgtcggcgcgaagcgtaccgttgatctcctgcgggtcgttgaagccagcccaggtcagaatgccgccgctaatcagcagcgccacgaccagcgccgccactgcgccgctggaaggaaccaccagccgatgccagacaaacggcaatattagccagatgccgaaaaacaccaggatatcgctacgcggcgtgagtgcccagaagtcgaacccgacttcccacacgccccaaatcattgtcgccagcagcagggcggcatacagccacagtgcggcacgtttactgcgccatagcaatccggccacaaccagcatcacgaggcccgcgatggggtagtaccaggaaccgccaatagcaaccagccagacacctccgataagaagatacagcccgcaaagtgctgcaaagagggccgtcagcgtcacgagtaatcgtggcgatcgtgcgttattttctgccataaaaagacaccatcccaaattgttaattttttagtagcaattaagcataggaattaacatgtgtgatcgtcatcacaaaatgagctttcttatcaaatgccgcgaatgaatacgtttgctgttatactgcgtgccttgcgcgtcaatgcggcgttattagtcaccggcattgagtgatttgtttttaaatcatatggttataaatatgaaacatactgttgaagtcatgatccccgaagcggagatcaaagcacgtattgccgagctgggtcgtcagattaccgaacgttataaagacagcgacagtgaaatggtgctggtaggtctgttgcgtggctcatttatgtttatggcggacctgtgccgtgaagttcaggttcctcatgaagtcgattttatgaccgcctccagttatggtagcggtatgtccaccacccgcgacgtgaaaatcctcaaagatctggatgaggatattcgtggtaaagacgtgctgattgtcgaagacattattgattccggtaatacgctgtcgaaggtccgtgaaatcctgggcctgcgcgagccgaaatcgctggcgatttgtacgctgctggataagccgtctcgccgagaagtggacgtgccggttgagttcgttggcttttcgattccggacgaatttgtagtcggttacggtatcgactacgcccagcgttatcgccatctaccgtatgttggtaaagtggtgctgctggacgagtaagcgcagaaatgccggatggcgtcgctaaagcgacttatccggcctatagctaatggcttattggtggggaatgtatttcagacttagggcggagatacccttatgatagccgttctccagcgtttctctgttggtggcggtgacgtcaagatcgcgcagcaggccatcattgatactgtacgcccagccgtgaatggtcacattctgcccgcgtttccacgctgactgcataatggtggaatgccccaggttatagacctgctccatgacgttcaattcatagagcgcgtccagacgttgctcttcgggcatttttcccaacagcgagctatgtttaagccagatgtcgcggatatgcagcagccagttattaatcaagcccagctcagggttttctaccgcagccttgataccgccgcaaccggagtggccgcaaatgataatatgctcaacttccagagcatctaccgcatactgaaccacggagagacagttcagatcggtgtgaataaccaggttagccacattacggtgaacaaacaattcgcccggttcaagcccggttaaacgctctgcgggaacgcggctgtcggaacatccaatccatagaaagcgcggtttttgcgcttgcgccagtttctcaaaaaatccggggtcctcttccaccagcatttttgaccatagtgcattgttgctgatgagtgtatctatgtctttcatggaagttaacgacctgtaaccaaataagtgcgttgggctaatatagggcaactccgtaattatttaaaccatatataaagtgtaagaacgtaaagtaagtgagaatttatgaccattgcgctggaacttcaacaacttaaaaaaacctatcccggcggcgttcaggcgctgcgcggcatagatttgcaggtcgaagcgggggatttttacgcgcttctggggccaaatggagcagggaaatcgaccaccatcggtattatcagctcattggttaataaaacgtccgggcgcgttaacgtttttggttacgacctggaaaaagacgtggttaacgccaagcgacagcttggactggtgtcacaggagtttaactttaacccgtttgaaacggtgcaacagatcgtagtgaatcaggcgggttattacggcgtggagcataaagaggcggttttacgtagcgaaaagtatttaaaacagctcgatctgtgggaaaaacgtcatgaacgcgcgcggatgctgtccggtgggatgaaacgccgcctgatgatcgcccgcgcattgatgcatgagcctaaactattgattctcgacgagccgacggcgggcgtcgatatcgaattacgtcgctcaatgtgggggttcctgaaagacttaaacgccaaaggcaccaccattattctcaccacccactatctggaagaggcggaaatgctgtgccgcaatatcggtattattcagcacggcgagctggtggaaaatacttccatgaaaaatctgctttcaaagctgaaatcggagacatttattctggatttagcgcccaaaagcccgctacctaagcttacgggttatcaatatcgtctggtggatacctcgactctggaggtggaagtgttacgcgagcagggggttaacagcgtctttagccaactgagcgagcagggggttcaggtattaagtatgcgtaataaagccaaccgtctggaagaactgtttgtgtcgctggtgcatgaaaaacaaggagatcgcgcatgatgcagctttactgggttgcccttaaaagcatctgggcgaaagagatccaccgctttatgcggatctgggtgcaaacgctggtgccgcctgtcatcaccatgacgctctattttattattttcggtaacctgatcggttcgcgcatcggcgaaatgcatggctttagctatatgcaatttattgtgccgggcctgattatgatggcggtcattactaactcctacgccaatgtggcctcctcgttctttagcgccaagtttcagcgcaatattgaggaactgctggtcgcgccggtgccaacgcacgtgatcatcgccggatttgtcggcggcggcgtggcgcgcgggctgtgcgtggggattctggtgacggcgatttcgctctttttcgtgcctttccaggtgcattcctgggtatttgtcgcgctaacgctgattctgaccgcgattctgttctcgctggccggactgctgaacgccgtgtttgccaaaacctttgacgatatcagtctgatcccgacctttgtgctgacgccgctgacctacctcggcggggtattttactcgctgacgctgctgccgccgttctggcaagggttgtcgcacctgaacccgatcgtctacatgatcagcggtttccgttatggttttctgggtatccatgatgtgccgctggtgacaacgtttggcgtactggtgatctttatcgctactttctatctgctgtgttggtcgctgatccagcgcggacgcggtttgcgtagctgatacgattctcctcttctcctggagggaagaggagacttttgacggctgtcatcattcccgattgatcaccctgataaactacttgcctgctaaggaggtaggttatgttaggttgggtgattacctgccatgacgatcgtgcacaggatatgcttgatcgcctggagagaaaaaatggtccgctggcgcaatgccgggcggtcaatttttggcgcggtctgagctcaaacatgctgagccgcatgatgtgtgatgccctccatgccaccgattccggtgaaggcgtgatatttttaaccgacatttccggcgcggcgccttatcgtgtagcgtcgctgatgagccataaacatcctcaatgtgaagttatttcaggcattagctattcattgatagaggaaatgattcctttgcgagagtcgatgagcagttcagcatttcgtgaccagattgtcgcgcttggcgcgccggatgtcaccagtctctggcatcagcagcagaaaaatccgccttttgtattgctgcatgatttgtatgagttttgatcaataccattgacgacgcttttgctacaataacggcgttttttcgcctcggttatgatatatggttatgcgtgttgttcttatcttgctgttctttttcgccggtaatgtgttggctgccttgcccgctcgttatatgcaaacgacgaaagatgccgccatctggtcgcagattggcgacaaaatggtgaccgtagggaatatccgcgccggacaaattctttccgtaacgcctgttgcggttgattattatgcctttaaatttggcttcggtgtggggtttatcgataaaggccatctgggacccgtgcagggaaaacaaaaagtggaagatgggctgggcgatcttaacaagccgctcagcaatcagaatctggtgacctggaaggacacgccggtgtataacgcgccggacatcagtagcgccccgtttggcgtattggtggataatttgcgttaccccattattagcaagctgaaaggccggctacatcaaacctggaatcagatccgtattggcgacaggctggcttatgtcaacgccatggatgcgcaggaagacaacggcattccgattttgacctatcatcacattttacgtgatgaagagaatacccgttttcgccatacctccaccacgacttcggttcgggcattcagcaaccaaatgacctggcttcgcgatcgcggctatgccacgttgacgatgtaccaactggaggattacatctataaccgcgctaatttcccggcgcgcgcggtggctatcacctttgatgatggccttaaatcggtgagtcgctatgcatatccggtattaaagcagtacgatatgaaagcgacggcatttattatctcatcgcgtattaagcgccatccgcaaaaatggaatcccaggtcgctgcaatttatgagcgtgtccgaattgcgcaagataagcgatgtttttgattttcagtcgcatacccattttttacaccgggtagacgggcatcgccgcccgattttatatagccgcagttaccataatattctgtttgattttgaacgttcgcggcgggcgctcacacagtttactccgcacgtattttatctttcttatccctttggcggctataacgcgaccgcgatcaaagcagcaaaagacgccggtttccatctggcggtcaccacggtgagagggaaggtgaagccgggagataatccgatgctgctcaaaaggctgtatattttacgcacggattcgctggaaacgatgtcgcggctgatagtcaatcagccgcaggggtaaggactatcaggcaacctgaaccggaatggctttcgcggtgcgcttcatttcgttgtcgccttcaaagtaggccactttcggacgccatgtacgcgcttcttcatcagacatggtgacgaagctggcgataatcacaatgtcgccaacttcagcgcagtgcgccgccgcaccgttcaccgagatgattctggagccgcgttcagccgcaatcgcataggttgagaaacgtttcccattggtcacgttccagatatcaatcgcttcgttttccagaataccggaggcatcaaggaaatcctggtcaatggcgcaggagccttcgtagtgcaggtccgcctgcgtgacttttacgcggtggagcttgccttgcagcatggtgcgaatcataacttctataccctgtcgtttatcttggctaagcaggcgcttgtagcctgctttggaaattctcaggcagtattgcccgatttttaacccctgtctactgggctaatgtaacgctttgattatcgatcagacgcgcctgtcccagccaggcggcagccagaatcactgcgcgtttgctggtttccgtcagctccagcagcgtgtcggcatcacggatttgaatgtcgtcggcacggaagcctttttcattcagttcctgctcggcaatggcaataatctcttgcagctcacgattacccgcaatcagtttttcagcgatgctattcatcacgttgtatagacccggcgcaattttgcgctgctctgcagtcagataagcgttacgtgagctgagcgccagaccgtctttagcgcgaataatcggcacaccgacgatctcaatgtcataacccatatccgccaccattttgcggatcagcgccagctgctggaaatctttctcgccaaagcaggcgatatccggctggataaggttgaacagcttgctgacgatggtcgagacgccgcggaagtggcccggacggctggtgccttccagcatggtagagaggccgggaacgtcaacgtatgtctgtccttccagcccctgagggtagatttcctcaacggctggggcaaagacataatcgactttgcgtttgttcagcttttcacaatcttcctgcaacgtgcgcggatagcgcaccagatcgtccggccgatcaaattgcatcgggttgacgaaaatgctgacgatgaccacatcggcccgggcttttgcctcatcgaccagcttcatatggccgtcgtgcaggttgcccatagtgggaaccagtgcgacgcgtttgccttcctgacgcagacggcgaatatgctggcgcagcagcggcagggtttcaatgattaacacaacaagactccttgagttgcttgatgatccagcccgatggcgctgcgcttatcaggcctacatccgttgaggatctgtaggccggataagacgcttcgcgtcgctatccggcacggtcagaaaaattagtgaaagctgtgttcttcgcccggataaacgccggactccacttctgccatatactgccgtacggcggcgcgcatgtcgcccgcctcggcaaggaaatttttcgcgaattttggaatatgaccgccggtgatgccaaacgcatcgtgcatcaccaggatctgaccgtcggtgacgttgcccgcgccgatgccgatcaccggaatcgacagcgcttccgtgacgcgcttcgccagttcaaccggcacgcactccagcaccagcagttgagcgcccgctgcttctaaggccagcgcatcatccagcagtatctgcccggcatcgccgcggccctgaattttatagccgccgaagatattcaccgactggggagttaatcccagatggccacacaccggcacggcgcgttcggtgagcattttcaccgtatcaaccaaccatgcgccgccttcgattttgaccatgttggcccccgcacgcatcacgatagccgcgttttcaaacgcctgttccggcgtggcgtaagccataaacggcaggtcggagagcagcaggcagttcggcgcgccgcggcgtaccgcgcgggtgtggtaggcgatatcttccacggtgacaggcagggtggagtcgtgcccctgaattgtcatgcccagcgagtcgccaaccagcatcacattgatgccttcatcggcgaagagtttggcgaagctgtaatcgtacgcggtaatggtggcgaagcgctttttctcttgtttgcatttctgcagcacagcgatagtagtgggtttgctcataacctctccggccataatattgatgaatagaatggccgcattgtaggggaagagaaccgcaagcgttagccttttctgggcaaattgcgttgcggttcgttataggattttacggataggtgattgaaaattgagcggtggctttgaaatcacctggattgattgttggattgtcaccatcgggctttaaggttgcctggaaatacaacgattttgtcgcgcttcctaccgggctgccgtctccggtgttattggtggtatctttataaattgagcttgagtcgttaggtttgagtaccatctgggcgctcgaactacttttcaaaccttcaattaaaacgccaatgccgctggctttcgtgttgctggttgaattgttggttagtagcgaggtgtttttcgtcccgacattattactggccaatttaacttcaatattattgatgtactggcaggaggagagattgatctggaacttggtcggcgacagcccttccataatctgctttggataaaagctacccagcttaaccgttgatcccgaaacattggtgccgctaatggtgctggccgagcaggttggccagacggccttaagtcctgtggcggcgaggttaaacttcattttatagtttgataatccgctgcccgggttatcaatgtagaaatcggagtcgccgtttttagacagcgtaaagctttgaagctgggcttccgtcggcgcgaagtcagagtcgacataggcatagattttcaggccatacattaatttgccaaggttgctataaacatttgttctggagcaggctgacggaaattccgtgaactcgctggtgatcggcgttgaggtcttatcaaaccagaaggtgcttgaggtcatattctctgctggctgaaggaaggtcatctcaatggtgaaataaaaaccgggaattgaggttttatacagcggatgtccattatagcttttgccagcagagatataattatgggtcagttgaaggtaggtgtggttgccgctgccgttacagaacatctccataacgtactggatgccggaccagttaaaaacggtaatctggcgcagcgccgtttccttatgaatcgcgatggtctgcccaaaattgtggctgttatcagtgaataccgaatccccgcttgggccatcatgttcactggaggcgtagtcgccaacggccagggtagtatttatggcataacagttggacatgatagccatcatcaggaaaaaggcggcaaaccatgttgtgttttttaaaagcatattaacgatatcctttcgtttaataaaatctcctgattattcataggagacattcaccagtacacggctgctaagttcaccggtcgtcactttttcggcactgcgtattttttgcattctggagtaaaaggtccagacggtgtcgctgtaggtgctggcagcaaaagtcgcccgcgatgaaccatccgtattaagcacgttggtgcgtggtgaatcggtggtgaaaatcaccacgccgacattgtctacgccaccagcatcggtagcgatgtcattaggaaaaacttgttgattctcaggtgagaactgcccgtttagtggtgcgaaattaaaggtgacattggttattttaccatcactgatcgggcaagaaataagcttaatggtgaactctttccccccctcataatcggtttccgcggtaatgccatcggcaaaataggcgggcgctatggtggcgaagtttaccgttccattgccatctatctttatctggcaggtgtccttctgcacgctggcggtgaaattcacattggtatcggcgtacagcgtcgcgctaaacagggctgttgccagccctgaaaataacgtggcgagcgtgggttcgcgcaaacgtctcattggtatcaccattactggtaagtgatggtgaaggtggtgggcgagtagaaatctcccgctgtcatattttgaagcgtaccgccgctttgagcgaccatcatagcgcttaaaggaaaatcaacaggcgttgttacacttgcaccagataaatccacggtttgttctggtttcgaccagcagtgaagttttaccgcgccagtgcctccaggggtttctgtcgtccatacttccatggcgaccattgctgcctttgttgttgaagtcgaggcatttgcgaattgcccatcagtgccgctgctccccgggcatgctacattatttggggctagtctgaacttagcttttttatctttgagaccgacacaatcactgaaccgtaacttgaaaagttttattttactttttgcatatacttcagaaatgtaaacgttgccaaaagcgatagtatcggtaatggtatcaccttcaaccacggatgcagaacacgtacccgcagtgatattggcgttcacggtcaggtccagactgttggttccatcggcatatgtcatcgttgatatgccagctcccgtggcaatcagcgagctaaaaatcacgacgcgcaatatttgctttttcattatcatcgtccttgttattgataagtgaagttaaacgtagcggttgagctgaaagcacctgtggtacccgcgccgtcggtcagttcacgcagcgcgaccgtcatttccacttcgtttgctgcgcgctcgtcggaagtccagctaaatgagcctgagccgggcgtgaaataggtttcatcggtagtgcttttgcgcttaaagcccatgccaacattggtggcagcgccgcttgccgctgattggtttttgataaaattgccgctggcatctgtggagctggcaagcgtggtggtgattttggtcagagcggcactgcaatccttcgcgacaaacttaaagtttttctgcgattccgctgatttttttataattttatccaacccgacatcgccgacgttcagcgtatagccgctggtggcatcacccgataagttcgagccatctaacgccgcaattgacatgctgcaggtcgtggctaacacggtggcggtaaagtcgacgttgatattttccgcctgactggtaagcggaaatatcacggcgagcacagaggctgctaaaaggtatttattccttttcattgtctattccatttgatttaaggttattaacacgacaggttatgtggtctaacagtaaggtctggctggaccctaccgtttgttgcgttgccggcaacgcaaaggttgctaaacaagttgctggctggttttcttcaaaccagcgtactgagagttcgcctgcatcgctgatgccgcgaacaaaagcctgaccgccctggcccatgttgtcgatctgcacatcgttctcgtagacttctgcgccaaatggtagggcttttccgtcattacgggacatgttgagaatgaccgagcgtccctggtcagtttcgaaactggctaagactaccgcgccatcacgcggtatcagggttgtactggtgctctttagttcgacatcgttttccagcgtgtcgatatcaatattgacctggttttctctgtaggcggaaagcgagttcgtcgcgccgtagccccagcgatcgatggtgctgttgccgccattgatgcgcgcgcctttcgcgccaggggcttttaccagcacgatggcatcgctattaccgaagttatcgttagtgaacgtcactccaccgccatgcaggacaaagtctccggttgtggcgagcgaatattgtcggctgctgtcattattggcagaggctgaagcagtaacatctccccagggggactgatagctggcgtagccgctgacatcggtgatgttcttttcatttttctgcatggtgtagccggtgttaacgctgtagttcagcgtgtggtcttcactgctgccgttgctgttcatgctcaactggtacccgccgtcaaaatcagtgcgcatttgcgccgtcagtgagctgaaacccgacttacggcgaccgccgcccagcagattctccagcggaacgttgaagttgatatagagcgaatcatctttttcgccatcttcatcccaggatctctggaggttgatactgaggctgccccacgaaaaacctcttccgtaaccgaggctatagtcggtacggctttcattggtagcccagtagtcggtccaggagcctgagaggaaaaaggaaccgtagtcgacttccttaaacctcaacggttggtttatgctgaccgtgacctggtttttcatgcgcgaatagttaagcatggtgttgcgatcgtccgcgtctttatgtttcgcgtcatcaatcagctgtagcgcatcattcaggcccaggtagtcctgcgttgaataacgatatgccgctacgttaaaggaggttgccgtcggttcaatcagcttgttccacgtcagtcggtagctctggcccttataggttttatcctcagggatctctgtacgagactgagtgacatcaagtgcaaatgcgccaagaggggtgttgaggccgacacccagcaacccggcaagatagttattatctgttccctgaacacctgtatagagggtcaaaaagttattaaggccgtagtaatatgaaccttgcgccatatagggcttgtcatgaagctcatcgtcattcacttcaccggcgctgaaatcccaacgtccgacgcccgggcgctgcatctgcataaccgaggagaatggctggctaaaggtgcgtttactgccgtcggcctcctcaacggtgacgatgaggtcgctaccgtagccggaaggactgatgtcgctgatttcaaaggggcctggcggtaccgtggactcataaattttgtagccgccctgggttatgctgaccttggcgttactgtttgctacgccgcgaataatcggcgcatagttggcaagctgcgaaggtagcattcggttgtcgctatacagacgagccccgcgaatgcttacggagtcaaatgtttcgcccgtggtataggtttcaccgacaacaagttgagagcgcattgaaggcagatcgcgctgcaagtagcgattctgatagtcaaaggagcttcctgagtctttcgtccagttatagttgccgttggcgcgaaaacgccatgcgccgaggttaataccggtgttaaacgccgcatacatactgtcattatcggcgctgccattggtgctgtgatagccgttagccgagtaggacagaagcgctgccggaataccatcttcccacagcgaaggctcaacatagccgtcataaccttcaatgagccacgcctgaggtacggtaatatccagacgctgttcgcccatatcaaaattgacctctgaatgcgcgatggcgacgggaaggttcagacaatcttgatcttcttcctccccttttttcagaatttgattggtcgcattgatttctggctgtttgatatgcaactgcgccagatttttttgtgtcaggcaggcttctgcactgaccttgccgatatcgataaagggtatggacaggcttgatacggggttttcgttgacaaaaactttcacgctatacgttccgacaggcgttgggttgccgtcggagtatttgctgatatcgattgtggaggcgctactccccattaaaaaggaactgtcgtattcaacgctttcagcggaaatactgctctggctataaaatagcgcacagcaaactgcgagcatcgttttcttcggcatggccttggaatgtggaaagttttacaccgatttcttcatcctgattcttggttaatccgttacagcgatacggaaccttcaatcaaaccgccaaaatcattaatggcgtgatactccagttttccggcgctagcgcctgacaagcctttcacggtgaaggatgatttactgaaaggcgcaaccatggtggcttcaacgtcataacgtttaccgcctgcagtgtaggtagcgtcattaaatgagacgaaatacggagttgagttatcagcacgtagtaccgcgtagccttgttcgctcgctatttgccacttcagttgttttgccgcttcagcaggctggccttttagtcctgttgggcgatagaacagtttgatacgggtacgaaaagccagttgcagtaagcttttattctcttctttgctggtatccgcttttggcggtacttccagtacgttaaaccagaagacgctttcccggtctttcggcagcgcgctggcctgggtatacataatttttaccgattgcccacgtttaggctcaacgcgtgaaaccgggggggtagaaacgaaaggcgctttaatactcccgggatcgtcgttatcgttacccaggtctatccagttttggactaataatgggcgggtacccttattttccagtcgtatactgacgtcttttttattttcgtcataaacgattctggtgcccgagataataatatccgcatagctaaaggtactaaatacagcactggctaatacgatggcggtcaggcttttttttacatacaacataagcgttccttgcctgtagaagataatgaaatcaactttgaatttaattaaattgaatgaacccccggaatcgttgaaataattcctggaccccgaaggttatatgagatcaataactgataagcacgctaactcaaggaaaggtacgagtacttattagtgataaccgtatgtcctgttactggtaagtaaaggtatacattgcgttcgtggttacatgaccggtagtcacttctttagaagcatcggcacgaacgtaagacgccataaagttataggttgcaactttgtttttgaaggacgcttcatgaatttcagcgccatcgattttaacctgagttttggtatcggcatcatggatggcgatattcacgttttcagccccagtttcaccagccacggacagtgtggtgtcattgtcaagagtgccggtagtgttagagaatgacgaatccattaccagagaagccttagtggcatcagttacatcagccgcgcctgagcaatccaggatgatagagaacggagccggaagcgcgccgtatgcgttagcagcaacgccttcagtgatatcgcctggggctgctgtagtcagatatacgtcaccatcagtcgcttgattaccgcgtgaagaggaaactactttagaacaggttgttgcgctcactaaaccgtggaattcgatctggccgccttcaactgccattgcggaagtagaacccatagccataaccattgcggcagctaaaatcgcttttttcattgctgtatccttacaggattgaaatgttaataaattaaatatctattaatttatattaaatagcagggcttggattttagcgtttgaggataatttttgtataatatttattatttattatttattgttttttgcgatgaattacctctgattatatttaaggatattctgacattttattcattgtgttattaatagtgttattcatggtgtgtatgtttaattgcattaagcggctgttttttaaacggatagctgaaatatatggtttgttactatgttatataatatacgactggttccatgattatttctaacaagagtatttaatttatctaattatacggaataacagcatagaaactatttgttgaattgataataggggtatttcttaccaacgatcgggacagggagacatttgggacatcagctcgatcagcagacctttatcgtcgggaaacaccagctccggagcgatttcgaataacggccacagcataaaaccgcggtttttcatgtcgtagtgcggcacggtcagacggtcggtgttaatgacttcatcgccaaacagcataatgtcgagatccagcgtgcgcggcccccagcgttcgaccttgcgcacccggccctgttgcagctcaatgcgctgggtatggttaagcaattcttcgggggcgagagcggtatccagcgccaccgcagcgttcaggtaatcgggctgatcctgtgggccaagcggcggcgtgcggtaaaacgaagaaaccgcgacgatacggctatcgggaatgtcggcgatagccttcagggcggcattgacctgctccagcggagaggccagattactgccaagcgcgatatacgcgatcgtcatacggtgccctcgcggcgcggcgcgcgtttgcgcggacgtgaacgacggcggcgtggagcaggatcgtcgtccagctcgttgagcatccctttttgttccggcggcgcggaagcctgaaactcggcccaccactgcgccagacgttgcagttcagtattattttccacttgggcgcgcagctccagcaaatcaaacgcggcgcggaatttgggatgttccatcagcttccaggcgcgtttgccctggcgtcgcgacatgcgtaactgaagctgccaaatatcacgggtaagcgtggtaaggcgtttcgggatcgccagtgaacggcaggcttcatccagcacgtcattcatggccagcgcgaaagcatcgtaataggcaaggccgctctcctgagcgattttttgcgccatctccagcagcggataccagaacatggcggcaaacaaaaatgccgggttaacgcgcatctcgttacggatgcggttatccgtattcttcaacacctgcgcaatgatgcgttccattgcgctgtcgccgttttcggtgaaataacgcgtaatggtaggaaacaacggctggaagaggtggtattcccgcagttgttgataggtttcaaaaccgttccccgcctgcaacagcttcagcgattcttcgaacaggcgcgcgggaggaatgtcgtttagcaaggttgccagacgcgggattggctcagccgtttcagggctgatacgcatattgagcttcgcagcgaaacgcacggcgcgcagcattcgaaccggatcttcgcggtagcgcgtttccggattgccgatcaggcgaatcacgccttcttgcagatcctgcatcccgccgacgtaatcgcgcacggtaaaatccgccacgctgtagtaaaggctgttgatggtgaaatcgcggcgctgggcatcttcttcgatagagccgaagatgttgtcgcgcagcagcataccgttttgcccacgctgggaggtcgtacggtcgctttcactgccttcattatgaccacgaaacgttgccacttcgataatttccgggccaaacatcacgtgagccaggcggaaacgacgccccaccagacggcaattgcggaataatttccgtacctgatccggtgttgcgttggtggtcacatcgaaatccttcggctttttaccgagcaggagatcgcggacgccgccgccgaccaggtaggcttcatagcccgctttgttcagcctgtacagtaccttgagggcattttcactgatatctttgcgggagatagcgtgctgttcacgcgggataatcgtcatatgtggacgggcgacggcttgttctgcctcgctctcctcgcggcttaacaccttacggcaaaaattagcgactcgggtaaaaatagcgcacctcggtagtgtcatacattaataagatcaacttactctatgtctttcgcattacggcagacgggcgtaagagagcaacgcgacctgggctgtaagcatcattaacgccgcagcaatgcgaaagacgatgagcaaaaatagcggctaatcatagctcagcgagacgcatttgagaatgccggatttacattagccgatgtgggtacggctgtaagcctccagtgcgccaccgcaaagcgcagcaactcctcaacagacatctcctgccacgctacgacgtcgcgttggcctaaaaagcgcaatgcctggaccagtaccgggcgcggatcgcctgtcgcaagcgcaggggcatgattttgcttggaaagtttagcgccttgttcgttgagcgccagcggaaggtgcacgtaacctggcgcacgccagccaaactgtttatacagcgaaagttgtcggacagtaggttcgattaaatctgcgccgcggacgatctccgtcaccccctgaaaatgatcgtcgaccaccacggccaggttataagcaaacagtccgtcgcggcggtggataataaaatcttcgctagccagctgtgggtcagcctggatgtcgccgcgcaaggcatcatggaaatgcatcactggatgctgctgtttaattctgacggcggcattctccggcccgtggcataacgtccggcaatggccatcgtaaataccgcccagacgttgaatgcgcgagcgggggcaagtgcagtagtagctcagtccctgctcgtgaagccaggccagcgcctcgcgataagcctcatgacgctgtgattgccataagacctcgccatcccagtgcaggccgtaatgttccagctggcgcagaatggtcgctgcggcaccgggaacttcacgtggggggtcgatatcctctatgcgaacgcgccaaactccgcgttgcgcacgggcttgtagatagctgccgagggcggcgattaacgagccgaaatgcagttcgccggatggcgacggcgcgaaacggccaatatagtgtgagtcagtcatgctgcgggcaataaagaataaggcgggaaaactcccgcctgtcataaatagggtagaaacgaacgggattaacccgccatctgtttttcgcgaatttcagccagcgttttgcagtcgatgcacagatcggctgttggacgcgcttccaggcggcggataccaatctccactccgcaggactcgcaataaccgaagtcttcatcttccactttcttcagcgttttctcgatctttttgatcagtttgcgctcacggtcacgattacgtaactccaggctaaactcctcttcctgcgcggcgcgatcgaccggatcggggaagttggcggcttcgtcctgcatgtgcgtcacagtgcgatcgacttcatcccggagttgattacgccatgcttcaagaatacgcttgaagtgcgatagctgggcttcgttcatatactcttcgcccggtttctcctggtacggctccaccccagcgatggcgagaatactcagggacgatgttttacggttttgcccttcttgcatgttgcttctccttaacacgcactatcgatccccatgttcgggggaaaatcaggtcgctataaatagcagatgcttttccggatagcaattatctaaacgtaacacttgacaaccctgtgaggaaaagcgtatttacgcacgcggccagaatacttaataatcaggctgttattccactacaacgttatgggcactggttcgttcagttccatttttgtggctgaaagttctgctttataagctaaaacttccacgcctttattctgagcctcgctcaatagctgcgcgtattttatatcgatatgacgtgcgggggaaaaacgtgtaatggcggagtgcagcacagcgaataccaccaccgcgcgatgacctgccgccgcaacgcccatcaactcccgaagatgtttttgccctcgttcggtgatggcgtcgggaaaataaccgttttctttttccgctaacgtgaccgatttcacttcaatatagcagtccgggcggaaatctgcctgtaacataaaatctatacggctgcgctcggcgccatatttgacttcactattcagaatattgtaccccgccagcgccggcaggcgattctcctgaatcgcttctttcgttagctggttcgcccgcagcgtattcacgcaaatgaatgcgccggattgcgtttcagtcaattcccaggtatgcggatatttgcgtttagtattttctgatgtcgaataccagacggtatcgccaggcgtggcgcagccagtcatcgcgccggtattaggacagtgcagcgtaagcgtcgtaccgtcaggggtgatgacatcagctaaaaaacgtttatagcgctgaatcaacgtagcgcgttgtaaagggggtgagaatagcatcgacattccttgattattattcgcccagcgtccagcgctgcagctcggcatagcgggtacggccttgcccatacgaagaggcgtaaagcgcaaacgatgtgaccggaaatgaccagcaaaagcccggcggcgggatagccaccgtatggctggcgtcgcgcagcagcgtaatatgcgggtgaaaaggctgcgggctttggtaacaaccgctgcgggcggcctgcgcgcgcagcatattagccaactgcaacaacccgcgcggcggctggcgcattcccagccacacaacgcgcgaacgcaaccactgaccggcgtcatctagatgtagcgtaaagcccggttggcgaattcgtccggccagttgcgcaagcgcgcgctgcttatcgttactgacgtcgcctaaaaaggccagcgtcaggtgtaggttcgccgctgccacggggcgtccgtcttcagacgcaaaatgggcggcgcgccaggcgataatttgcgcgcgcgcgtcgtcgggtaagtcaatagcaaaaaacagccgttttggctcagacatagggatactcggttatggattaacacgatgctacaatgcggcgcaaagaaagttaaccccgtggagccgtttgtgacgtcattgcccgttgccgccgtattgcctgaattgttgacagccctaaaaaccgcgccgcaggttttgttgtccgcgcctaccggggcggggaaatccacctggctgccgttgcaactcctgcaacaggggccggttgctggaaaaattctcctgcttgaaccgcgtcgtctggcggcgcgtaatgtcgcccagcgtctggcggaagcgttgaatgaaaagcctggcgaaacggtaggttaccggatgcgcgcgcaaagctgcgtggggccgcgtacccggctggaagtggtgaccgaaggcgtattgaccagaatgattcagcgcgatcccgaattacgcggcgtggggctggtgatactggatgaatttcatgagcgcagtttacaggcggatttagcgttggcgctgttgctggatatccagcaagggctccgtgacgatctcaggctgttaatcatgtctgcgacgctggataacgacaggctttgtcagcgactgcctgatgcgccgacgatcgtctcggaggggcgcgcgtttcccgtggagcgacgttatcagccgcttgcggcgcatttgcgttttgatgaagccgtcgcgatggcgacagcggaactgctgcgcaatgaaaacggttcgctgctgctatttttacccggcgtaggcgaaatacagcgcgttcatgaacatctggcgtcgcgggtagggagcgatgtcctgctttgtccgctgtatggcgcattgtctctggaagcgcaacgcaaagcgattgttcccgcacccgccgggatgcgtaaagtggtattggcgactaacattgccgaaaccagtttgacgattgaagggattcgtctggtcgtcgatagcgctcaggagcgcgtggcgcgattcgacgcgcgaacgggactgacgcggctggttacgcagcgtatcagtcaggcgtcaatgacgcagcgcgcggggcgcgccggacgactggcgccgggtatctgtttacatctgctggcaaaagaacaggcggagcgggcggcggcgcaaagcgatccggaaatcttacacagcgacctctccggtttgttgatggaggtgttgcagtggggatgtcacgatccggcctcgcttttctggctggacaggccgccggaggtgaatcttcaggccgcccgccgtttattattgatgttaggcgcgctggagggcgagcgattaagcgcgcgggggcggaaaatggcggcaacaggtaacgatccgcgcctggcggcgatgttagtcaacgccgacgagggcgacagcgccgccactgccgccatgctcgcggccatccttgaggacccgccgcgaggcggcggtacggatttaagcgtgctattttcgcggcgacagccgggctggcagcagcgtagccagcagcttttaaaacggctgcaggtgcgtaatggcgagccggatagcgcgcttattatgccgctgttggccagagcgtttagcgaccgcatcgcgcggcgtcgcggtcaggaagggcgctatcagttagccaatggtatgggcgcgatgttagatgcggatgacgcgttgggacgtcatgaatggctgatcgcgccgctgttactgcaaggtagcgcctcgccggacgcccgaatattgttggcgcagccgctggatattgcctcgctgattcaggcgtgtcctgatttactgcgccagtccgacacggttgaatgggacgaggcgcagggaacgttgaaagcatggcgcagaatgcgtattggacagttgacggttagcgttcagccactggcgaagccgtctgaagaggagcttcatcaggcgatgctgaacggcatccgcgataaaggtctgtccgtccttaactggacgccggaagcggagcagttccgtctgcgtctgcactgtgcggcgaaatggctgccggaatatgactggcctgccgtggatgaggcgtcgctgctggcgactctggaaaattggttgctgccgcacatgacaggcgtacagtcgttacggagtctgaaatctctgaatgtgactcaggcgttacggggactgcttgactatgccatgctgcaacgtctggatagtgaactgcctgggcattacactgtgccgacgggaagccgaataacgattcgttatcatgaagataacccgcccgcgctggcggtcagaatgcaggaaatgttcggcgaggcaagtacgccgacacttgcgcaggggcgagtgccgctggtgctggaactgctttcgccagcgcagcgaccgctacagattacgcgcgatttaagcgctttctggcagggggcgtatcgcgaagtgcaaaaagagatgaaggggcgttaccccaaacatgtctggccggacgatccggcgaatacggctccaacgcggcgcacgaagaagtattcgtgacgtgttatacgttgcctccaggccggataaggcgttaatcgccatccggcaaaaaggtaaattgagagatttcttcttctgtcgtctggcggaagaatagagaatcgggcctttgcgcctgtatgttgcggagaaaaagcatggcggggaatgaccgcgagccgattggacgtaaggggaaaccgtcacgtcctgtgaaacaaaaggtgagccgtcgtcggcagcatgacgacgattatgatgatgactatgaggatgaagaaccgatgccgcgtaaaggtaagggcaaagggcgtaagcctcgtggcaagcgcggctggctgtggctattgctaaaactgtttatcgtttttgtggtgctgttcgccatttacggcgtctatctggatcaaaaaatccgcagccgtattgatggcaaggtctggcagcttccggcggcggtatatggccggatggtgaaccttgagccagacatgcctgtcagcaaaaacgagatggtgaaattgctggaagcgacgcagtatcgtctggtgacgaagatgacccgtcccggcgaatttaccgtgcaggccaatagcattgagatgatccgtcgtccgtttgacttcccggacagcaaagaagggcaggtgcgcgcgcggctgacgttcagtgacgggcgtctggaaaccatcgtcaatctggataacaaccgccagtttggcttcttccgcctcgatccgcggcttatcaccatgctttcttcgccaaatggcgagcagcgtttattcgtcccgcgcagcggtttcccggatctgctggtcgatacgctgttggcgacggaagaccgtcgtttctatgagcatgatggcattagtctttactctatcgggcgtgcggtgctggccaacctgacggcgggacgcacggtgcagggggccagtacgctgacccagcagctggtgaagaacctgttcctctccagcgaaagatcatactggcgtaaagcgaatgaagcctacatggcgctgatcatggatgcccgttacagtaaagatcgtattcttgagctgtacatgaacgaggtctacctcggtcaaagcggggataatgaaattcgcggttttccgctggcgagcctgtattactttggtcgtccggtagaggaactgagcctcgatcagcaggcgttactggtggggatggtaaaaggggcgtcgatttataacccgtggcgtaacccgaaactggcgctggagcgtcgtaacctagtgttacgcctgttacagcagcagaaaatcatcgatcaggaactctatgacatgctgagcgcgcgtccgcttggcgtacagccgcgcggcggcgttatttcaccgcagccagcgtttatgcagatggttcgtcaggaactgcaggcgaagctgggggataaaattaaagatctctccggcgtgaagatcttcaccacctttgactccgtggcgcaggatgccgcagaaaaagccgttgtcgaaggcattccggcgttgaagaagcagcgtaaattgagcgatctggaaactgcgatggtggtagtggatcgctttagcggcgaggtacgcgcgatggttggcggggcggagccgcagtatgctggctataaccgtgccatgcaggcacgccgttccatcgggtcgctggcgaaaccggcgacctatctgaccgcgttaagtcagccgaacttataccgtctgaacacctggattgccgatgcgccgatttctctgcgccagccgaatggtcaggtctggtcgccggagaacgacgatcgtcgctacagcgaaagcgggaaagtgatgctggtggatgcgttaactcgttcaatgaacgtaccgacggtcaatctggggatggcgttaggtttaccggcggtaaccgatacctggacgaagctcggcgtgccgaaagatcagctcaatccggttccggcgatgctgttaggggcgctgaacctgacgccgatcgaagtggcgcaagcgttccagactatcgccagcggcggaaatcgcgcgccgttatcagcgctgcgttcggttattgcggaagatggtaaagtgctgtaccaaagttatccgcaagctgaacgcgccgtaccggcacaggcggcttacctgacgctctggacaatgcagcaggtcgtccagcgtggtacggggcgtcagcttggcgcgaaatatccgggtctgcatctggtgggtaaaaccgggacgacaaacaacaatgtcgatacctggtttgccggtatcgacggcagccaggtgactatcacctgggtaggccgtgataacaaccagccaacgaaattgtacggtgccagcggcgcgatggcgatttaccagcgctatctggcgaaccagacgccgacgcctttagttctgacgccgccggaagatgtggtggatatgggcgttgattacgacggtaattttgtctgtaacggcggtatgcgcactctgccggtctggacggacgatccaaatacgctgtgccagcagggcgagatgatgcagcagcaacagcagccgtcaggcaatccgttcgatcagtcgtctcagccgcagcagcctgcgcagcaacagccgccgaaagaagagaagagcgacggcgttgccggctggattaaggagatgtttggcggcaattaatcacggtaatagtgccgggtggcgctgtgcttactcggtccacaccgttacgaccccattatgtgcgacgtaggccgaataagacgcttacatcgccatccggcaaatcctccataaataacatttcagtctaatttattaacccttccttttcatctggttgtttcttaaccccttagttttcgtagggccgcgtatcgcttgccattgcgacgatatttcgcctatcatgctgcggttataataataattatcgtttacgttatcattcactttcatcagagatataccaatggcgcgtcttaaaattgctcagccaaactcctcactgcgtaaaatcgcagttgtagtagccacagcggttagcggcatgtctgtctatgcacaggcggcggttcaaccgaaagaagaaaccattaccgtaaccgcagcgcctgcgccgcaggaaagtgcctggggaccggctccgaccatcgccgcgaagcgttccgccactaccaccaaaactgatacatctatcgaaaaaacgccacagtcggtttcggtggtcactaacgaagagatgcagatgcatcaattccagtcagtaaaagaagcgttgggttacacgccgggcgtaactgtaagcagtcgcggcgcttccaatacctatgacttcgtgattatccgtggcttctcttccgtcggcctgagccagaataactatctctggatggcctgaaattgcagggtaacttctacaacgatgcggttattgatccatccctgcttgagcgtgttgagttgatgcgtggcccaacgtccgttctctatggtaagagcaacccgggcggtatcatttcgatggttagcaagcggccgactactgagccgctgaaagaaattcaattcaaaatggggacggacaatttgttccagaccggttttgattttagtgattccctggatgacaacggtgagttctcatatcgtctgacggggctggcgcgctcgacaaatgagcagcaaaagagttctgagtcgcagcgctatgcgattgcgccctcttttacctggcgtcctgatgagaaaacgaattttacgttcctttcttatttccagaacgaaccagagactggctactacggctggctgccgaaagagggaacggttgaaccgttaccgaatggtaaacgcttgccaacagatttcaatgaaggggcgtcaaacaacacctattctcgtaacgagaaaatggtgggatacagtttcgagcatggcttcaacgacacttttaccgtgcgccagaatttacgttttgtcgaaatgaaaaccgcgcaaaaaagcgtctatggcacggggattgcggcggacggccatacgcttaaccgcggtactatcgttgacaacgagcgtttacagaatttcagcgtagatacacaactggaaagtaaattcgcgaccggcgatattgatcatacgttgctgacgggtgtcgatttcatgcgtatgcgtaatgatattaacgcgacgtttggtagcgcgccgtcaatcgatctctataacaattaccatcctgaatactttgctttcggcggcgctgagccgtaccagatgaacgaaagtaaacaaacagccttatatgttcaggatcaggcggaatggaataagtgggtatttactctcggcggccgttatgactggtctaaacaagcgataacggtgcgtcagaattccactacgccgacagaaggatatattgaacgtaatgaccaccagttcacctggcgcggtggcgtaaactacgtattcgataatggaatttcaccttacttcagctatagccaatctttcgagccaagcgccttcgatttgtggagcaccccacgtgtttcttacaagccgtcaaaaggcgagcaatatgaagcaggggtgaaatatgtaccgaaagacatgccagttgttgttacgggtgccgtttatcagctgaccaaaaccaataacctgaccgccgatccaaccaacccattagcgcaggtgccggcaggcgaaattcgtgcgcgaggtgtagagctggaagccaaagcagcattgacggctaatatcaatatgacggcgtcttacacttatactgatgctgaatacacgaaagacactaacctgaaagggaatacgccagagcaggtgcctgaacacatggcgtcgttgtggggcgattacaccttcaacgatggtccgttgtcaggtttaacgctgggaacaggcggtcgttttattggttccagttacggcgatccggccaatagcttcaaggtaggcagcgcagcggtgatggatgcggtcgtcaagtacgatctggcgcgttttggtatggcgggctccagcattgcggttaacgttaataatctgctcgaccgcgaatacgtcgccagctgcttccagacctacggctgtttctggggcgcagaacgtcaggtcgttgcaacggcaaccttccgtttctaatttctttttgggcacggcttgccgtgcccgttttacaagttggctgcgatgcaggaaaaccacattcattccgataccacctttgcgctgcgaagcgtcgcttttcgtgtgccgggccgcacgcttttacaccccctctcgttaacgtttcccgcaggtcgagtcaccggacttatcggccataatggttccggtaaatccacgctgttaaaaatgctgggccgccatcagctgccttccgaaggggatattctgctcgacaatcagccgctggcgagctggagcagcaaggcgtttgcccgcaaagttgcctatctgcctcaacaattgccgcaggcggaaggaatgacggtgcgcgaactggtggcgattggccgctatccgtggcacggcgcgttgggacgctttggcgtcgcggaccgggaaaaagtagacgaggcgattacgctggtcggcttaaaaccgctggcgcatcgtctggtcgatagcctgtccggcggtgaacgccagcgcgcgtggattgccatgctggtcgcgcaggacagccgttgtctgctgctggatgagccgacgtcagcgctggatatcgcccatcaggttgacgtgctggcgctggtgcatcgtttaagccaacagcgcgggctgacggtggttgcggtgctgcacgatatcaacatggcggcccgctactgtgattatttagtagcgctacgcggcggtgaaatgattgcgcaaggaacgcctgcggaactgatgcgcagtgacacgctggaacagatttacggtatcccgatgggtatccttccgcatccggcgggcgccgcgcctgtgagttttgtgtattaatgcgtgagttatatcctcttactcgccgccgtttattaacggcgatggcgctctcgccgctgctgtggcaaatgaatacggcgcaggctgccgctatcgatccccgccggattgtggcgctggagtggctgccggttgagctgctgctggcgctcggtattacgccttatggtgtggcggacgtgccaaattataagctgtgggttagcgaaccgccgttgccggattcggtgattgatgtgggtcttcgcactgaacccaatctcgaactgctgacggagatgaagccgtcgtttatggtgtggtcggcaggttacggaccctcgccggagaaactggcgcggatcgcgccggggcgcgggttcgattttagcgacggcaaaaagccgctggcggtggcccgacgctcgctggttgaactggcgcagacgctgaatctggaagctgcggcagaaaaacatctggcgcaatacgatcgcttcatcgccagccagaagccacgttttatccgccgcgggggacgtccgttactgatgacgacgcttatcgatccgcggcatatgctggtgctcggcccgaattgcctgttccaggaggtgctggacgagtatggcatcgtcaatgcctggcagggtgaaaccaacttttggggcagtacggcggtcagcatcgatcggctggcgatgtataaagaagcggatgtgatctgcttcgatcacgggaatagcaccgatatgaacgcgctgatggcaacgccgctgtggcaggccatgtcgtttgtccgcgccgggcgttttcaccgggtgcccgccgtttggttctatggcgcgaccctctccacgatgcattttgtccgcatcctgaataacgtgttgggaggcaaagcgtgagcagaaaacgtgaaataccggatggcggtgcgaaaaacgccttaaccgacctacggttcgggcgctttgtaggccggataaggcgaagctgccatccggcgttgctgttattggcgctgttggttgccgcctgctggctgacatgggttaacttctccgttgcgctaccgcgcagtcagtggcaacaggctatctggtcaccagatatcgacatcattgagcagatgatttttcattacagccagctgccaagactggcgatttcgctgctggtgggcgcggggcttgggctggtaggcgtcctgttccagcaagtattacgtaacccgctggcggaaccgaccacgctgggcgtggcgaccggcgcgcaattggggatcacggtgactacgctttgggcgattcccggcgcgctgaccacgcagtttgccgccctgacgggagcctgcatcgtcggcgcgctggtgttcggcgtggcgtggggcaaacgtctgtcgccagtgaccctgatcctcgccgggctggtggtcagcctctattgtggcgcaatcaaccagttactggtgattttccaccacgatcagttgcaaagcatgtttttatggagcactggaacgctaacgcaaaccgactggagcggcgtgcagcgtctgtggccgcagttgctgggcggcgtgatgctcacgttattgttgttacgtccgatgacgctgatggggctggatgacggcgttgcgcgtaatctggggctggcgctgtcgttagcgcgtctggcggcgttgtcgctggcgattgtgttgagcgcgctgctggtcaacgcggtgggcattatcggttttatcggcctgtttgcgccgctgctggcgaaaatgcttggcgcaagacgtctgctggcgcgcctgatgctggcgccgctcattggggcgcttattttatggctatccgatcagattatcctttggctaacccgcgtatggatggaagtctccaccgggtcagtgacggcgttaatcggcgcgccgctgctcctatggctgctgccgcggcttaaaagcatgagcgcgccggatatgaacgccagcgatcgtgtggcggcggagcgtcgacatgtcctcacttttgccgttgccggtggcgcgctcctgctgctggcaacatgggtcgcgctctcttttggtcgcgacgcgcacggctggacgtgggcgagcggaacgctgcttgaagaactgatgccgtggcgctggccgcggatactggcggcgttaatggcgggcgtcatgctggcggtggcgggctgcattattcagcgtctgaccggtaacccaatggccagcccggaagtgctggggatcagttccggagccgcgtttggcgtggtgttgatgctgtttttggtgccggggaatgctttcggttggctactgcctgccggaagcctgggcgcggcggcgacactgctgattattatgatagccgccgggcgcggcggtttctcgccgcaacggatgttgctggcggggatggcgctcagcaccgcgtttaccatgctgctaatgatgctccaggcgagcggcgatccgcggatggcggatgtgttgacctggatctcaggatctacctataacgccactggcgggcaggttacgcgaaccgcgatcgtgatggtgattttgctggccgttgtgccgttgtgtcgccgctggttaacgattttgccactgggcggcgatgccgcgcgcgcggtgggcatagcgcttacgccgtcgcgtatcgcgctgctggcgttggcggcttgtttgacggcaaccgcgacgatgaccattgggccgctgagtttcgttggattgatggcgccgcatattgcgcggatgctcggttttcgccggacgatgccgcatatggtcatctcagcgctggcagggggcgttttattggtctttgccgactggtgcggcaggatggcgctatttccgtatcagatcccggcgggactgctttcaagctttattggcgcgccgtactttatctatttgctacgtaaacagagccgctgagtttgccggatggcggcataaacgccttatccggcctgcggtgtagaatgtaggccgggtaagcgtaagcgtcacccggcaattcatcctttacaatttcgcaaacacccgacgcgcggcgtcaatagtattattaatgtcgtccatgctgtgtgcgaccgacataaaacccgcctcaaacgccgatggcgccagatacacgccttcctccagcatcaggtggaagaaacgcttaaagcgttccacgtcgcacgccatcacgtcctgatagcaagttacgctctcagcgtcggtgaagaaaatcccgaacatgccgccgacatggttaaccaccagcggaatattcgcttcttcggcagcttccagcaaaccttccgccaggcgggtggtgagctcatccagcgtttcatgaatgccgggctgggcgacttcattcaggcaggcgaaaccggccgccatcgcaatcgggttgccggaaagggtgcccgcctggtaaaccgggcccgtcggcgccagcgcatccattacatcgcgacgaccgccaaacgcgcctaccggcatcccgccgccgatgattttacccagacaggtcaggtccggcacgacgccgtagtaatcctgggctccggccagcgctacgcgaaaaccggtcattacttcgtcgataatcagcagcgcgccgaactcatcgcacaaggcacgcaggcccggcaggaattccggcagcggcgggacgcagttcatattgcccgccacgggttcgacgatgatacaggcgatttcctgcggatattgttcaaacgccgcgcgcactgacgtcagatcgttataagtgcaggtcagcgtatgtttcgcgaaatctgccggcacgcccggcgagttcggctgaccgagcgtcagcgcgccagaaccggctttgaccagcagacagtctgcgtggccgtggtagcagccttcgaatttgataatcttatcgcggccagtaaaaccacgcgccaggcgaatcgcgctcatcgtcgcttcggtgccggagttcaccatgcgcaccatgtccatggtcggcaccaggttggtcaccagttccgccatttttacttccatttcggttggcgcgccgaagcttaaaccgcgctccgcagcttcgatcaccgcattgcggatagccggatggttatgccccagtaccattggcccccaggaaccgacatagtcgatatatgctttgccatcgacatcgtacagatacgcgccgtccgctttttcgataaacagcggggtgccgcccacgccagtgaaggcgcgaacaggggagttcacgccgccggggatcagctcgcgggccgcgctatagagattttcagacttactcatggaaagattcctggttcgtagaaaaagtgaatacccgctattctaagttattcagagaaggttatgaaagttttacgcatttgaaacaatacgatttgcaggggattttcacggcgttggcgagtagaatgccgactttagatttgtattaccaattaatgatcttctgatgaaaacagacacttccacctttttagctcagcaaattgtgcgcttacggcgcagagatcagattcgtcggttaatgcagcgggataaaacgccgctggccatcctgttcatggcggccgttgtcggcacgcttaccggactggttggcgtcgcctttgaaaagacggtttcctgggtacaaaacatgcgcattggcgcgctggttcaggtcgcggaccatgcgtttttgctttggccgctggcctttatcctttcggcgttactggcgatggtcggctattttttggtgcgaaaatttgcgccggaagccggcggctcgggtatcccggaaattgaaggcgcgctggaggagttacgtccggtgcgctggtggcgcgtgttgccggtgaagtttatcggcgggatgggaacgttgggcgcaggaatggtattagggcgcgaagggccaacggtgcaaatcgggggcaacctggggcgcatggtgctggatgtttttcgtatgcgcagcgccgaagcgcggcatacgttgctggcgaccggcgcggcggcggggctctctgcggcgtttaacgcgccgctggcgggtatcctgtttattattgaagagatgcgcccgcagtttcgctacaacctgatttcgattaaagcggtgtttaccggcgtcatcatgtcgagcattgtgttccgcatatttaacggcgaagcgccgattattgaagtcggcaaactgtctgatgcgccggttaacacgctgtggttataccttatcctcggtattatttttggctgcgtcgggccggtatttaattcgttggtgctgcgtacccaggatatgtttcagcgctttcatggcggcgaaattaaaaaatgggtgcttatgggcggcgcgatcggcggcctgtgcggtattctggggttgattgagccggcagcggcaggcggcggatttaaccttattcctatcgccgcggcaggtaattttagcgtcgggctactgctgttcatctttattacccgggttgtcacgacgctgctttgcttttcttccggcgcgccggggggcattttcgccccgatgctggccctgggaacgctgcttggtacggccttcggtatggcggcggcagtgcttttcccgcagtatcacctggaggccggtacctttgcgattgccgggatgggggcgctgatggcggcgtcggtgcgcgccccgttgacggggattgtgctggtgctggagatgaccgataactatcagctcattttgccaatgattatcacctgtcttggcgcgacactattagcccagtttttgggcgggaaaccgttatactcaaccatcctggcgcgcactctggcgaagcaggatgcggaacaggcggcgaaaaaccagaatgcgcctgcgggcgagaatacttgaacgaattaccagggtattagataatgactgccaatattgggtgaaaatttatccaattaccgatgtcgtttggagcaaaatatgagtgatgacgtagcgctgccgctgcagtttaccgacgcagcagcgaataaagtaaaaagtcttatcgctgacgaagataacccgaatctgaaactgcgcgtgtatatcaccggcggtggttgcagcggcttccagtatggttttacctttgacgatcaggttaacgaaggggatatgaccatcgaaaaacagggcgttggcctggtggttgacccgatgagtttgcagtatctggtgggtggttcggtagattataccgaaggtctggaaggttcccgcttcattgtaaccaacccgaatgcgaaaagtacctgcgggtgtggctcttccttcagcatttgattgctgttcgttgtgccggatggcgacgcgaacatcttatccggcctacaggaaagatgttccaggcccgataagcgtagcgccatcgggcaaaacaatatcaacgtccgttttcatccagggcaaacgtcggcaatttcaaatgccagcgaatggccgccagccgaataaacagcgtgacgaccatgcccatcatgctagcgctttccagcggtactgaaaacgtataaaacgcggtggcgtgaacaatcccgccgataatacaggccgtggcatagatttcggtgcgtaggatcatggggatctcgcgtgccagaacatcgcgaataatcccgccgccgacgccggtaatcacgcccatacagacggccactaatggccccgtttcagcgaggaaggctttattcaccccaatgccgacaaacaccgccagcccgaccgcatccagtaccggcaacatccatttcggcagacgtctcggctggcgaaccagcaggatggtcagcatactggtgaccatggcgacgaccaggtcggtaggatctttaacccagaataccgggccgttatccagcgccatatcgcggattgtcccgccgccgacggcagtaacgacgccgagcaccaggacgccgaacgggtccatacgtaatttcccggccagcaacacgccagagatagcaaatacagccgtgcctacaatatccagccaatagacgagcattgtcgaatccccactaggagcctggtaagacaggctctaattcacctgtgaaagcgcattacagagttgttttgcggcgaggataatacgcgggcttgcgcgttcaaaccagtcgctgttaagcggaataaccggaatttttaacaggtttccccagtattgttcaattttgagaatttcgcccgcttttccggccacgataatggcctggggatgccttgccagcacctgctcacggctgacttgcggccacggcacgcggctgtcagcaaagacgttttctccgccgcaggtcgtcaaaacctgatgttgaatagaccctttaccactggtaaacagaggattcatgccaaactgaagaaagacgcgctttttagctttaccggcatactcgactttgagcgcggcgtactcttttagcaatgtctgcgctgcctgctgagccttttccggctgcgggctccaggcggccagttggcggagcgcgtcggcgatctgttcgatggttaccgcgtccacccacatgaccttaatacctaatgacgtcagttggtttacctggcgttccgcattaccgccgcgccaggcgacgaccagatccggcttcagcgccacaatgcgctccagattcattccctgccaggtagagacctgttctattttttgcgcttcgggcgggtagtcggaatagctgctgacgccaacgggcgtaatctcggcggcaaaagcaagctccgtattggcgggagagagcgtaattacgcgcggcgcagcgtaaagccacaccgggagcgtaagcagcagggcgcccagcgccctgaacatttgcttagccatgcgccagtttctgtaccagcgtttcgaccatcagagtcgactgtttcgccgccaccgcgaggaattcgtcaaagctgaggtgcgattgctgatcggccacgtcagagatagcgcgtaccaccacgaacggcacgttgaagttatggcagacgtgggcgatagcggtggcttccatctctacggcgaccgcgtcggggaagttatgccggattttcgccagcccgacggaaccgttaataaacgcgtcgccgctaacaataaggccgcgtaccgcgttcagattcaactccctgatgcaggattccgcggcggcgatcagcttatcatcggccttaaatccggccggacagcccggtaattgcccgtattcatagccgaaagcggtcacatcagcgtcgtggtaacgcgcttcgtcagagacgacgatatcgccgaccttcagcgtggacgccagaccgcctgcggaaccggtattgatgatcacgtccggcttgcagtgctccagaagcaacgttgcgcccagcgccgccgcgactttaccgataccggatttcagcaacgccacttcggtgccgttcaactggccagtgtaaatttcgcagccgcccagcgtaatcgtctgacggttgtcaattttgtcacgcagcagcgtaacttcttcttccattgcgccaatgatgccgattttcatagatttactcgcgataagtcagttttgggggcatagtttatcatgcgcttatggggaagcgcatttctcaggcggggagaggatatggcatcgatcgatttccgaaataaaattaactggcatcgtcgttatcgttcaccgcagggcgtaaagacggaacatgagatcctgcggatttttgaaagcgatcgcgggcggattatcaactctccggctatacgccgtttgcagcaaaaaacgcaggttttcccgctggagcgcaatgccgcggtgcgtactcgtctgacgcattcgatggaggtgcagcaggtggggcgttatatcgcgaaagagattttaagccgcctgaaagagcaaaaccgactggaggagtacggtctggatgcgctgaccggtccctttgaaagtattgtggaaatggcctgtctgatgcacgacatcggtaatccgccgttcggtcattttggcgaggcggcgatcaatgactggtttcgtcagcggctgcatccggaagatgcggaaagccagccgctcacgcatgatcgctgtgtggtttcctcgctacggttacaggaaggtgaagaaaatctgaacgatattcgccgcaaagtacgtcaggatatctgccattttgaaggtaatgcacagggaattcgtctggtacatacgctcatgcggatgaatcttacctgggcgcaggttggcggaattttaaaatatacccgtccggcatggtggcgagggccggtgccggattcccatcgctatttaatgaagaaaccgggctattatctttctgaagagaagtatattgcgaggttacgtaaagaacttcagttagcgccttacagtcgctttccattaacgtggattatggaagccgcagatgatatttcttattgtgtcgccgatcttgaagacgcggtagagaaaagaatctttagcgttgagcagctttatcaccatttatatcacgcgtggggccaccatgagaaggattcgctgtttgagctggtggtaggaaatgcgtgggaaaaatcacgcgccaatacattaagccgcagtaccgaagatcagttttttatgtatttacgggtaaatacattaaataaactggtgccctatgccgctcagcgttttattgataatttgccgcagatttttgccggtaccttcaatcaggcgttactggaagatgccagcggttttagccgcctgcttgaactctataagaatgtggcggttgaacatgtgtttagccatccggatgtagaacagcttgaactacagggataccgggtgatcagcgggttattagatatctatcagccgctattaagcttgtcgcttaacgactttcgcgagctggtggaaaaagaacggttgaaacgcttccctatagaatcgcgcttatttcagaaactttctacgcgccatcgtttggcctacgtggaagtcgtcagtaaattacccacggattcggcggagtacccggtactggaatattattatcgctgtcggttgattcaggattatatcagcgggatgactgacctttacgcatgggatgaatatcggcgtttgatggcggtcgaacagtaaatggacttttgtaaagatggacaataaatttttactttttccagaaactttattccggaacttcgcgttataaaatgaatctgacgtacacagcaattttgcgttacctgttaatcgagattgaaacacatgaaaaaaaccacattagcaatgagtgcactggctctgagtttaggtttggcattgtcgcctctgtctgccacggcggctgaaacgtcctcttcagcaatgactgcccagcagatgccaagcctggcaccgatgctcgaaaaagtgatgccatcggtggtcagtattaatgtagaaggtagcaccacggtgaatacgccgcgtatgccgcgtaatttccagcaattctttggcgatgactccccgttctgccaggacggttctccgttccagaattctccgttctgccagggcggcggtaacggcggcaacggcggtcaacaacagaaattcatggcgctgggctccggcgtaattattgacgccgcgaagggctacgtcgtcaccaacaaccacgtggttgataacgccagcgtgattaaagtacagcttagcgatgggcgtaaattcgatgctaaagtggtgggcaaagatccgcgttctgatatcgcgctgattcaaattcagaatccgaagaacctgacggcgattaagctggcggactccgacgcgctgcgcgtgggggattataccgtcgctattggtaacccgtttggtctgggcgaaacggtgacgtcaggtatcgtttcggcgctggggcgtagcggcctgaacgtagaaaattacgagaactttattcagaccgacgccgcgattaaccgcggtaactccggcggcgcgctggtgaacctgaacggtgagctgatcggtattaacaccgcgattctggcgccggacggcggcaacatcggtatcggcttcgctatccccagtaacatggtgaaaaacctgacgtcgcagatggtggaatacggccaggtgaaacgcggcgaactggggatcatggggactgagctgagctctgagctggcgaaagcgatgaaagtcgacgcccagcgtggcgcgttcgtcagccaggtgatgccgaattcgtccgcagcgaaagcgggtatcaaagccggggatgtcattacctcgctgaacggtaaaccgatcagcagctttgcggcgctgcgcgctcaggtcggcactatgccggtcggcagcaaaatcagcctcggtctgctgcgtgaaggtaaagcgattacggttaatctggaactgcagcagagcagccagagtcaggttgattccagcaccatcttcagcgggattgagggcgctgaaatgagtaataaaggccaggataaaggcgttgtggtgagcagcgtgaaagcgaactcacccgccgcgcaaattggcctcaaaaaaggcgatgtgattatcggcgctaaccagcagccggtgaaaaatatcgccgagctgcgtaagattctcgacagcaagccgtcggtgctggcgctgaatattcagcgtggtgatagttctatttatttgctgatgcagtaatcacctttgtcccccttccaccacggaagggggcaacacttttctgtgaaactccccacaactccatacttctttgcaccgttttgtgcatttgcacaatgtcgaggcctgtcatcttccttatgcttgtgctctgctcacaggagggatttatggctggctggcatcttgataccaaaatggcgcaggatatcgtggcgcgcactatgcgcatcatcgataccaatatcaacgtaatggatgcccgcgggcgtattatcggcagcggcgatcgggaacgtattggtgaattgcacgaaggcgcgttgttagtgctgtcacagggccgggttgtggatatcgacaacgccgtggcgcgacacctgcacggggtgcgtcaggggattaatcttcccttacgccttgagggcgaaattgttggcgtgatcggtctcaccggcgaaccagagcatctgcgtaaatatggcgaactggtgtgtatgactgccgaaatgatgctggaacagtcgcggttaatgcaccttttggcgcaggatagccgtttgcgtgaagagctggtgatgaacctgattcaggccgaagaaaatacgccggcgctggtggaatgggcacagcgtttagggatcgatttgaaccagccgcgtgtggcggcggtggtggaagtcgacagcggccagcttggcgtcgatagcgcaatggcggaacttcagcagttgcagaatgcgcttaccacgccggagcgtaacaacctgatagccattgtttcccttaccgagatggtggtgctcaaacccgccttaaactcgtttggtcgttgggatgctgaagatcatcgtaagcgcgtagagcagcttatctcgcgaatgaaagagaatggtcagctacgttttcgcgtggcgctgggtaattactttaccggaccgggcagtattgcacgctcataccgcacggcgcgcaccacgatgatggtcggcaaacagcggatgccagaaagccgcagctatttttatcaggatttgatgctgccggtcctgttagatagcctgcgtggcggctggcaggccaatgagctggcgcgcccgctggtaaaactcaaagcgatggataacaacgggttattacgtcggacactgacggcgtggtttcgccataatgtccagccgctggcgacctctaaggcgctgtttattcatcgtaatacgctggaatatcggctaaatcgtatttcggaactgaccgggctggatttgggaaattttgacgatcggctgttgctgtatgtggcgctacaattggatgaacagcgttaagcccggcggcgcttcgcttaccaggcctacggggatatacctgtaggccggataaggcgtaacacgtcgccatccggcaacacacagcttacttacgggtaagcttgtccagatcggcttcgatttcactgatcttattcgcgacgacgctttccagatggcgcaagtcgtcgaggatcttacgtttgagatcgagttctgagcggtcgcgctggcagatttggtccagctcgtcaatcacatagcgtaggttagggctaatctcctgtacttctttataaccctgaccgatgccatcagccaccaccgttttacgctggcgtggatacttaaacttcacgcttttagcaaagaattcacctctatccttttgaaaatagattttcaggatatcgttattggcttcttgccgcaggctgtaacgatcgatttcctcaggattggtaatgcccagactttttagattgtcatacatagcggtatccttcatcacactataacttttgaataattaacgaaaaattggtttttcgccaccaatggatacaaaaaaagcgcggttgatcgcagaagacgtctcggcaacgtcatgagcaaaagggcggcggttattgatagcttaagtaattcaacgcgatattccgtttatagagaaagcgtttgaggtcagtgtgggaaattgaccggaggcagtggtcgataaccttgagaggcggaatctatgtccggaacgtataatgccactattcgccgggtggtgatttccgcctggataggaaactccattgaatattatgattttctattatacggcttagcaagcgcgctggtatttggcccgctttttttcccctggcgccagcccattgactgcaacgttatcttcttttgccagtttcggcgtgggatttatttcccgaccgctgggcgcgctattttttggcaacaggggggatacgcttgggcgtaaaaacacgttattaatcacgttaggcgggatgggcgcggtcacgtttctcatcggttgcctgccttcttacgccagtatcggcgcgctgacacctgctttactggttattctacgttttctacagggatttatggttggaggtgaatggggaggcgccatgttgatggtcgtggaatatgctgctggaaagcaccgggggcggttaagcgcgctatcgcaaacaggaggactcacgggacaattattggcgacaggcgtatttatagtcgtgacccaattaccgcaggaggcgttgttatcgtggggatggcgtattccttttctgctcagtgcgcttttggtgttgccgggattatatatgcgtcatcgtctggatgagacgcctgtcttccgtgcgtttaaaaagcagcaggccattaatcataggcagcaaagggatgaaaggccggtggtcaaagtagtacgagaacaatggcgtagcattttgctgattataattctgcgttttgcggaaagcgttcccttttttcttgctaccgtcttcgcggtttcctgggcgacgacgcagcttgggattgccagcctgactattctgtacattgtaatgttcacctgtctgctggcgtatcccatgcacgtgctatttggcatcatgtcggatcggcgtggctgccgtcaggtgtatattttcggcgcgctttttgtcgcggcaatggcttttccctttttctggctgctggaaagccgttcgctcatactgatgacaatgggctacgttctgcttattaacattggtcataattcactgaatgccgtgcaaccttcttttttcgccggactgtttcatccgcctgtacgctacagcggttcatcaattggcgctcagttgggggcggttgtggcagggggattcacgccgtttatcgctaaagcgttaagcgcagtctatgataacagttggactttggttgccggttatgtcgttttgactgcgctggcttcggcgtttgcggcaaagattgcgccggacaccgtgttaccgcattcgccgtaatgcaaaggggggctgtcgcccccgcttttcactcgcttaatcaatcgtgcgcaataattcgttaatgcccactttaccacgcgttttggcgtcgacttttttcacgatcaccgcgcagtacaaactgtacttaccgtcttttgacggcaggttgccggaaacgaccacggagcccgccggtacgcggccatagtgaacttcaccggtttcgcgatcgtagattttggtgctctggccgaggtatacgcccatggaaatgacggaaccttcttcgacaatgacgccttccacgacttcagaacgcgcgccaataaagcagttgtcttcaatgatggtcgggttagcctgcagcggctccagtacgccgccgatacccacgccgccggaaaggtgaacatttttaccaatctgcgcacaggaacccaccgtcgcccaggtgtcaaccatggtgccttcgtcaacgtaggcgccgatgttaacgtaagacggcatcagcacggtgttgcgggcgataaatgcgccctgacgaacggccgcaggcggaacgacgcggaagccttctttctgaaaacgcgcttcgtcgtaatcagcgaatttcatcggggctttatcgaagtagcggctttccgcaccgtcgataacctggttatcgttaatacggaaagagagcagaaccgctttcttcaaccactggtgagtgacccactgaccgtcgattttttctgcgacacgcagcgcgccggaatcaagtagagaaatgacctgttttaccgcctctcgggtcacggtatctacattagccggcgtaatatcggcgcggcgctcaaaagcggtctcaataacgttctgtaactgctgcattgttaaactctttcatataaataaacacactaccctttatcgtttggattgagggccgctgtcaaccgttgttgcacctcaagttgcagcacattattaagtgcgcgccgatccgctgtggcgattatgaataaatcttctactcgttcaccaatggttgtaattcgggcaccatgaagcgaaattcccagatcggcaaaaatttgtccgaccctggccagcagaccaggttgatcgagcgcgatcaattccatgaatgattttctgtcggtatgggtgggcagaaaattgacttccgtttcgaccgtaaagtgccgtaactttgccggttgccgacgcggctgcggcggctgccagctatgctgcgtaatggtctgttcaagaccggtgcgaataacgtcatggcgatctgccgccagcgggctgccgtctggttccagaacgataaacgtatccattgccatgccgtcgcgagtggtaaagatctgcgcgtcatggacgcttaaattacgcctgtccagctcggcgcagacggcggcaaacagatagggtctgtccggactccagataaaaatttcggttccgccgcgcgtggcttgcggactgagcaacactaacggttggctcagatcgtgctgcaataaatggcgtgcgtgccaggcgagctgatttggactatgacgaacaaaatagttagcgcgacagcgggtccagattttgtgcagcgcggcttcatcaatattgtccattcgcagcagcgccagcgcctgaagctgatggtgacgcacgcgctcacgcatatccggcgtattttgcattccacgcctgagctgtttttcagtggcgaagtacagctcgcgcagcaggctctgtttccagctattccacaaggtttcgttggtcgcgcagatgtccgcgacggtcaggcagaccagaaaacgcagccgtgtttcggtttgcacctcttcggcaaactgcttgatgacttccggatcctggatgtcgcggcgctgagcggtgactgacattagcaggtgttggcgcaccagccaggcgaccagttgcgtttcgcgtgagttcaaaccgtgcagttcggcgaaggtgagtacatcctgcgcgcccagtaccgaatggtcgccgccgcgtcctttcgcaatatcgtggaacagcgcggcgatcaggatcagttccggatggggaagccgcggccagagatcgacgcatagcggatggcgctggcgtgtctcttctttcgcaaagctctccagtttgagcattacgcggatggtgtgttcatccaccgtgtatgcgtggaacaggtcaaactgcatttgtccgacgatgtgcgaccactgcggcatataagcccacagtacgctgtggcgatgcatgggcagcaggccgcggctgaccgcgccgggatggcgtagcatactcagaaacagagtgcgcgcctccgggatgtaacacagcggttggctcaggtggcggcgggcgtggcgcaagtggcgtaacgtcgtagagtagatgccggtgatcgcgctattgcgcaccatcatataaaacatccgcaggatcgcttgcggttcgcggataaacagcgtgtcgtcacgcagatcaatgagcgtgccgcgcagttgaaactcatcgtcaacaggacgtggtttttcatccgcaggcagcgccagaatcgcctcgtcaaatagctgaagcagcatctgattaagttcgctcacccgacgcgtaacccggaagtagtctttcatcatccgctcaaccggatcattgccctcgccgctgtagttaaggcgttgagcgacgcttaactggcggtcgaacagcaggcggttatcgtagcggctgaccaccagatgtagcgcaaagcgaatgcgccacaggatatgcaggcactcgttgagctccgcgcactcagccggggttaaaaagccgaatcccaccatctcatcgagcgaggtggcgccgaagtgacgtcgggcgacccactgcaatgtatggatatcgcgcaggccgccggggctgcttttaatatccggctccagattatagctggtaccgtgatagcgctggtggcgctggttctgctcttctactttggcggcgtaaaatttgtcggacggccaaaaaccttcgctgaaaatatgtttttgtagtgccagaaacagagcgacatcaccgatcagcaggcgcgtttcgatgaggtttgttgcaacggttaaatcagacagaccttccagcagacactcttccagcgtacgtacgctatgcccgacatccagcttgacgtcccaaagtaaagtcagcagctcgccgaccttttgcgcctgttcatcgggcagctttttgcggcttaaaatgagcagatcaatatcggaaagcggatgcagttcgccgcgtccatagccgccgacggcgaccagcgccagatcggcaatctgaccgaaaccggcctcaatccacaggcgttgcaacaactggtcgataaattcggttcgggcttcaataagctgttcagcacaaatgccgctgtcaaatgcctctcccagccagtgttgaaagatgtcgatgcgggctttgataccggcgacggtcagttcagcgcgcggccagacgccagggttttgcggctggtcagggagggtggggagtgcggtattcgcgtgctgttcaggaagagtattcatatgcgccacccattaaaaagccggatggtggcgtgaacgccttatccggcctacgaagtagtacaatttgtaggcctgataagatgcgaaggcatcgccatcaggcaaaacattattcgtcgtgtgtgatgatcgccgggatggtgtcatctttacgcagcgtcagaatttcacagccgttttccgttaccacaatagtatgctcgtactgagcagacaagctgcggtctttggtttttaccgtccagccgtctttcatggtgcggatacggtaatccccggcattcagcatcggttcaatggtaaaggtcatgccaggctgcaacacgacgccaccatcgtctgcatcataatgcagcacctgcggttcttcatggaagccgcgaccaataccgtgtccgcagtattcacgtaccacggagaaaccttcgccttcggcatatttctggatggcggcgccaatggtgcgcaggcggatgcccggtttcaccattttgatgcccagatacaggctctcttgcgtgacgcggcacagacgctcgcccagaatagtcggtttgccgacgataaacatctttgaggtatcgccgtggaattcatctttaatcacggtcacgtcgatgttgacgatatcaccatctttcagatgtttagcgtcatccggaatgccgtggcacaccacttcattaatagagatacagacggatttcggatagccgtggtagccgaggcaggcggagatcgcgtgttgttcgttaacgatgtaatcgttacagatacggtccagttcgccggtggtgacgcccggtttgatatacggttcgatcatttccagcacttcggctgccagacggcccgcgacgcgcattttttcgatgtcttcagatgtcttgatagagatagccatgaattctgtccatcagtgccgatgatttcggcaataattgtgtaagtgctgacaatggtatcagtcaggggtgtaccctgccaaattgagaatcattctgaacttcgcctttcgtgccacaggtgcgttggcgacattttttcaccccagtcacttactggccgtaagctcccggggatgcaaaaatttgccgcctgcctgtaacacgaaattcatcgttcaattcagcactgagtgccaacaattattggtgtcggtggcgtatttgtggtataaagcgtgccggacttccgatccattcgaagactacacacgatggacgggagcgacaaatctcactttgtgtaacaacacacacgtatcggcacatattccggggtgccctttggggtcggtaatatgggatacgtggaggcataaccccaacttatctatagaggttttaaatcatggcaactgtttccatgcgcgacatgctcaaggctggtgttcactttggtcaccagacccgttactggaacccgaaaatgaagcctttcatcttcggcgcgcgtaacaaagttcacatcatcaaccttgagaaaactgtaccgatgttcaacgaagctctggctgaactgaacaagatctctgctcgtaaaggtaaaatccttttcgttggtactaaacgcgctgcaagcgaagcggtgaaagaagctgctaacagctgcgaccagttcttcgtgaaccatcgctggctgggcggtatgctgactaactggaaaacagttcgtcagtccatcaaacgtctgaaagacctggaaactcagtctcaggacggtactttcgaaaagctgaccaagaaagaagcgctgatgcgtactcgtgagcttgagaaactggaaaacagcctgggcggtatcaaagacatgggcggtctgccggacgctctgttcgttatcgatgctgaccacgagcacattgctatcaaagaagcgaacaacctgggtatcccggtatttgctatcgttgataccaactctgatccggacggcgttgacttcgttatcccgggtaacgatgacgcaatccgtgctgttagcctgtacctgggcgctgtcgctgcaaccgttcgtgaaggccgttctcaggatctggcttcccaggcggaagaaagcttcgtagaagccgagtaataaggcttgataactccctaaaatagttcgagttgcaggaaggcggcaagctcgagaattcccgggcgcttacatcagtaagtgtccgggatgagcgagtgaaggcaacgcgcctgcggctcgaaatatgaaggggagagcccttatagaccaggtagtatcacgtttggttagggggcctgtatatggccccctttttcacttttatatctgtgcggtttgatgccgggcagatcaaatctttcgaggattttagaatggctgaaattaccgcatccctggtaaaagagctgcgtgagcgtaccggcgcaggcatgatggattgcaaaaaagcgctgactgaagcgaatggcgacattgagctggcaatcgaaaacatgcgtaagtccggcgctatcaaagcggcgaaaaaagcaggcaacgtggctgctgacggcgtaatcaaaaccaaaatcgacggtaacgtcgctttcattctggaagttaactgccagactgacttcgtggctaaagatgctggcttccaagcatttgctgacaaagtgctggacgccgctgttgctggcaaaatcactgacgtagaagtcctgaaagcgcagttcgaagaagagcgcgttgctctggttgcgaaaatcggcgagaacatcaacattcgtcgcgtcgcttccctggaaggcgacgtgctgggttcttaccagcacggtgcgcgcatcggcgttctggttgccgctaaaggcgctgacgaagagctggttaagcagctggcgatgcacgttgcggcaagcaagccggaattcgttaagccggaagacgtgtctgctgacgtggtagagaaagagtaccaggtacagctggacatcgcgatgcagtccggtaagccgaaagaaatcgcagagaaaatggttgaaggccgcatgaagaaattcaccggcgaagtttctctgactggtcagcctttcgtcatggaaccgagcaaatctgttggccaactgctgaaagagcacaacgctgacgtgactggcttcatccgctttgaagtgggcgaaggcattgagaaagtcgagactgactttgcagcagaagttgctgcgatgtctaagcagtcctgattttcctgaggagccgcctgagggcggcttctttttgcgcctctcttgtaaaatcagccgacgcctggcgtctgcgctgaaatgcgacgtacaatgtcgccggaattaactcatatcaatcgttgacagtctcaggaaagaaacatggctaccaatgcaaaacccgtctataaacgcattctgcttaaattaagcggcgaagctctgcagggtacggaaggcttcggtattgatgcaagcatactggatcgtatggctcaggaaatcaaagaactggttgaactgggtattcaggttggtgtggtgattggcggtggtaacctgttccgtggcgcgggtctggcaaaagcggggatgaaccgcgttgtgggcgaccacatgggcatgttggccaccgtcatgaacggcctggcaatgcgtgatgcgcttcaccgcgcctatgtgaacgcccgcctgatgtcggcaattcctttaaacggcgtgtgcgacaactacagttgggccgaggctattagcctgctgcgtaataaccgtgttgtgattctgtctgcaggtacgggtaacccgttcttcactaccgactctgcggcctgtctgcgcgggatcgaaattgaagcggatgtcgtactgaaagcgaccaaagtggatggtgtattcactgccgatccggcaaaagatccttccgcgaccatgtacgatcagctgacctacagcgaagtgctggataaagagctgaaagtgatggatctggcggcgttcacgctggctcgtgaccacaaactgccgattcgtgttttcaacatgaacaaaccgggcgcgctgcgtcgtgtggtgatgggcgaaaaagaagggacgttaatcacggaataattcccgtgagcgccaaatacgggtaagattctgttctattgacgggtcttattacctggcagaaattaaacgagactatacttagcacatctttatattgtgtgaccgtctggtctgactgagactagttttcaaggattcgtaacgtgattagcgatatcagaaaagatgctgaagtacgcatggaaaaatgcgttgaagcgttcaaaacccaaatcagcaaagtgcgcacgggtcgtgcttctcccagcctgctggatggtattgtcgtagaatactatggcactccgaccccgctgcgccagttggcaagcgtaacggtagaagactcccgtaccttaaaaattaacgtgtttgaccgttctatggggccagccgttgaaaaagcgatcatggcgtcagacctcggtttgaatccaagctctgcgggcaccgatattcgcgttccgctgccgccgctgaccgaagaacgtcgtaaagatctgacgaaaattgtccgtggagaagcggagcaggcgcgtgtcgccgtacgtaacgtccgccgtgatgcgaacgataaagtaaaagctctgctgaaagataaagcgatcagtgaagatgacgatcgtcgctctcaggaagaagtacagaaaatgaccgacgcggcaattaagaaagtggatgcggcgttggcagataaagaagcagaactgatgcagttctgattgatctgtacgcagatataaactcattccaccgctaaacctggcggatgagtggtgtacaaagcgccgcgcagaagacattatcaggtctcctgtgcggcgttttgctttttattccgtttcaacacttctggacgtttcatgaagcaattaaccattctgggctcgaccggctctattggttgcagcacactggacgtggtgcaccataatcctgatagctttcgcgttatcgcgctggtggcgggtaaaaatgtcgcccgcatggcggagcagtgcctggagttctcgccgcgttatgccgtgatggacgatacgtcgagcgcagaacagctcaaaataatgcttcagcagcatggcagccgcaccgaggttctgagcggtcagcaggctgcctgtgagatggcggcgcttgatgaggttgggcatgtgatggcggccattgtgggcgcggctggtttactgccgaccttggcggcgatccgcgcagggaagacgattctgctggcgaataaagaatcgctggtgacctgcgggcggctgtttatggacgaagtgaaacgcagcaacgcccggcttttacccgtcgatagcgaacataacgcgatttttcagagtttgccgcaatctattcagcataatctgggatacgctgaccttgagcaaaatggcgtaacgtcgattttgcttaccgggtctggtggcccgtttcgtgaaacgcccatgtgcgatctggcagcgatgacgccggatcaggcatgtcgtcatccgaactggtcgatggggcgaaaaatctccgtcgactccgccaccatgatgaataaaggtctggaatacattgaagcgcgttggttatttaatgccagcgcacgtcagatggaagtgttgatccatccgcaatcggtcattcattcgatggtgcgttatcaggacggcagcgtcctggcgcagcttggagaacctgacatgcgtacgcctattgcgcatacgatggcatggccgaatcgcgtcacgtccggcgcgcagccgctcgatttttgcaaactcagcgcgctgacgtttagcgcgccagattatcagcgttatccttgcctgaagctggcgatggaggcgtttgagcaaggtcaggcggcaacgacggcgctcaatgcggcaaacgaaatcaccgttgccgcgtttctggcgcaacagattcgttttaccgatatcgccgggctcaatttagcggtgctggagaggatggatttacacgaaccggcaagcgttgatgacgtattgcaggttgacgccatcgcgcgtgaagtagccagaaaacaagtgatacggctctcacgctgacgattatcccgcgacagaagatcgtgctatttgttagcgttgggcttcggtgatatagtctgcgccacctgatcgcaggtttttggcttttttcggtcaggttagccgtggttttacacggcttttttgtggatacacaaaatcattcaggacgcatcgggacggcaggcggatacgttcccggcgtgcgcagacagcgcacgacaggggcgatgacgcgcagtcattcgcgaagcgaaccgaagagaatgtgtataaaggcttcagtattcctgagtaccgctaaatcctttcagggacaaaaaacgcgttatgttgtctgcaactcaaccagtaagcgaaaatttgccagcacatggctgccgtcatgttgccataattatggatggcaatggccgctgggcgaaaaagcaagggaagatccgggcctttgggcataaagccggggcgaagtccgtccggcgagcggtctcttttgctgccaataacggtattgatgcgttaacgctgtatgcctttagtagtgaaaactggaaccgaccagcgcaggaagtgagcgcgttaatggagctgtttgtgtgggcgctggatagcgaagtcaaaagcctgcaccgccataacgttcgcctgcgtattatcggcgatatcagccgatttaactcacgtttacaagaacgtattcgcaaatcagaagcgcttaccgcccataatacggggctaacgttgaatatcgctgcgaattacggcggacgttgggatattgtccagggagtccgacaactggcggagctggtgcaggctggagtgctgcgccccgatcagattgatgaagagagactaggccagcaaatctgtatgcatgagctggcgcctgtggatttagtaattaggactgggggagagcatcgcattagtaactttttgctttggcaaattgcctatgccgaactttactttacggatgttctctggcccgatttcgatgaacaagactttgaaggtgcgctgcatgcctttgctaatcgagagcgtcgtttcggcggtaccgagcctggtgatgacaaagcctgatgggggtcgcttttgctgaagtatcgcctgatttctgcttttgtgttaatacccgcggtcatcgctgcgctttttttattgccgccggtggggttcgccattattacgctggttgtctgtatgctggccgcgtgggaatgggggcagttaagcggtttcgccgcgcgttcacagcgggtttggctggcggtgctgtgtggtctgttattggcgctgatgttatttttgttgcctgagtatcatcacaacattcgtcaaccgctggttgagatgtcgctttgggcatcgttaggatggtgggttgtcgcgctactgctggtgctattttatcccggttcggcggcaatctggcgcaactcaaaaacattgcgtctcattttcggtttgttaactattgtgccatttttctggggcatgctggcgctgcgcgcctggcactatgacgagaatcattacagtggcgcaatatggttactctatgtcatgatcctggtctggggagcggactctggcgcgtatatgtttggtaaattgtttggcaaacataagctggcgccgaaggtttccccgggtaaaacctggcaagggtttatcggcgggcttgctacggctgccgtgatctcatggggttacggtatgtgggcgaatctgaatgttgcgcctgttatcttgctgatttgctctgtggtggcggctctggcttctgtactgggcgacctcaccgagagtatgtttaagcgcgaagcaggaattaaggatagcggccacttgatcccaggccatggcggcattctggaccgaattgacagtctgacggctgccgtaccggtctttgcttgcctgttgttactggtgttcaggacgctctaacggaaggttttatgctgagtattctctggaatctggctgcattcatcatcgcactgggcgtgctgatcactgtgcatgaatttggtcatttctgggttgcccggcgctgcggtgtgcgagttgagcgcttttccatcggttttggcaaagcgctctggcgtcgtaccgatcggtacggcaccgagtatgtcatcgccctgatcccgctgggcggctacgtcaaaatgctggatgagcgcgccgaaccggtagcgccggaattgcgtcgtcacgccttcaataacaaaacggtgggccagcgcgccgcaattattgccgcaggtccggttgcgaacttcatttttgctatctttgcttactggctggtctttatcatcggcgtccctggcgttcgtccggtcattggcgaaataacgcccaactcgattgctgcgcaggcgcaaattgcgcctggtacggaacttaaagccgttgatggtatcgaaacccctgattgggatgccgtgcgtttacaactggtgtccaaaattggcgatcagcagacgacggtgagcgtcgcgccgtttggcagcgaccagcggcaggacaaaacgcttgatttacgtcactgggcatttgagcctgataagcaagatcctgtatcttctttagggattcggccccgcgggccacagattgaaccggtactgtcagaagtgcaggcgaattccgcagccagtaaagcgggtttgcaagcaggcgacaggatcgttaaagtcgatggtcagccgttaacgcagtggatgaaattcgtgacgtttgtacgtgataatcccggtaagccgttagcgttagagattgaaaggcaggggagcgccttgtcgttgacgttaacgccggatacgaaatcggttaacggaaaggcggaagggtttgcaggcgtggtgcctaaaattattcctctgccggaagagtacaagactatacgccagtatgggccttttagcgccatcctcgaagccacggataagacgtggcagttgatgaagctgacggtcaatatgctgggtaaattgataaccggtgatgtgaaactgaacaacctcagtgggccgatttctatcgctcagggggctgggatgtcagcggagttcggggtgatttattacctgatgttccttgcgctaatcagcgtgaacttagggataattaacctgtttccgctgcccgttcttgacgggggtcatctgctgttcctggcgattgaaaagcttaagggcgggccggtatccgagcgggttcaagactttagttatcgcattggctcgattttgctggtgttgttaatggggcttgcacttttcaatgatttctctcggttgtaagagagttagttaggaagaacgcataataacgatggcgatgaaaaagttgctcatagcgtcgctgctgttcagcagcgccaccgtatacggtgctgaagggttcgtagtgaaggacattcatttcgaaggcctgcagcgagtcgccgttggtgcggctctcctcagtatgccggtgcgcacaggcgacacggttaatgatgaagatatcagtaacaccattcgcgctctgttcgccaccggcaactttgaggacgtccgcgtcctgcgcgatggtaatacccttctggttcaggtaaaagaacgtccgaccattgccagcatcactttctccgggaacaagtcggtgaaagatgacatgctcaagcaaaacctcgaagcgtctggcgtacgtgttggcgagtctctggatcgcaccacgctgtctgatatcgaaaaaggtctggaagacttttactatagcgtaggtaaatacagcgccagcgttaaggcggtcgtcacgccgctaccgcgcaaccgtgttgatcttaaactggtgttccaggagggcgtatcggcgaagatccaacagatcaacatcgtcggtaaccatgcctttagcaccgaagaactcatttctcatttccagttgcgtgacgaagtgccgtggtggaacgtcgtcggcgatcgtaaataccagaaacagaagctggcgggcgaccttgaaaccttgcgcagctactatctggatcgcggctacgcgcgtttcaatattgactccacgcaagtgagtctgacgccggataagaaagggatctacatcaccgtcaatatcaccgaaggcgatcagtacaagctttccggggttcaggtgagcggtaacctggccggacattccgctgaaattgagaaactgacgaaaattgaaccgggcgagctctataacggcaccaaagtgaccaaaatggaagatgacatcaaaaagcttctgggtcgctatggttacgcctatccgcgcgtgcagtcacagcctgaaattaacgatgctgacaaaaccgtaaaactgcgcgtgaacgtcgatgcgggcaaccgtttctacgtgcgtaagatccgctttgaaggcaacgatacctcaaaagattccgttctgcgccgtgaaatgcgccagatggaaggggcgtggctgggcagcgacctggttgaccaggggaaagagcgtctgaaccgtctcggcttctttgaaaccgtcgacaccgacacgcagcgcgttccggggagcccggatcaggttgatgtggtgtacaaggtgaaagagcgtaacaccggtagcttcaacttcggtatcggttacggtacagaaagcggcgtgagcttccaggccggcgttcagcaggacaactggttaggtaccggttattccgtggggattaacggtaccaaaaatgactaccagacctacagcgaactgtccgttactaacccatactttaccgttgacggcgtgagcctcggtggtcgtatcttctataacgactttgaagcggatgatgccgacctgtccgactataccaacaagagttacggtacggatgtgacgcttggcttccccatcaacgagtacaacacgttgcgtgctggtctgggctatgtccataacaaactgtccaacatgcagccgcagatcgcgatggatcgttatcttgaatcgatgggcgaccctgatgccagcgattttgccgctgacgacttcacctttaactacggctggacctataacaagcttgaccgtggttatttcccgacggacggctcgcgagtcaacctgacgggtaaggtgacgattccaggttccgacaacgaatactacaaagtgtcgctggataccgcgacctatgtgcctattgataacgaccacaagtgggtggttctggggcgtactcgttggggttacggcgatggtttaggcggcaaggaaatgccgttctatgagaacttctatgccggtggttccagtaccgtgcgtggtttccagtcgaatactatcggcccgaaagcggtctataaaaatggcgcccacactagttgggacgatgatgatgattacgaagactgtactcaggaatcaggctgtaaatcagatgatgcggtaggtggtaatgccatggctgtcgccagcctggaatttattaccccgacgccgttcatcagcgaaaagtatgccaactcggttcgtacctccttcttctgggatatgggtaccgtttgggatacgaactgggatccgtcatctgcgccgtcagatgtaccggattacagcgatccaggcaacatccgtatgtccgcgggtatcgcattacaatggatgtccccattggggccgttggtcttctcctacgcccagccgtttaaaaagtacgatggagacaaagccgagcagttccagtttaacattggtaaaacctggtaattgttcactgcaaaggaatgcattggtagtgtagcgatgacttttggcgatgcccccagggatcgccaggccacgcaaagagctgtaccttcgggtgcaaatgggatggtaaggagtttattgtgaaaaagtggttattagctgcaggtcttggtttggcgatggttacgtccgcacaggctgctgacaaaattgcaatcgtcaacatgggtaatctgttccaacaggttgcgcagaagacgggtgtatccaatacactggaaaacgaatttaaaggccgtgcggctgaactgcaaaaaatggaaaccgatctgcaatctaaaatgcagcgtctgcaatccatgaaagcaggtagcgatcgtactaagctggaaaaagacgtgatgtctcagcgccagactttcgcacaaaaagcgcaggcttttgagaaagatcgcgctcgtcgttccaacgaagaacgcaacaaactggtgactcgtatccagactgcggtgaaaaaagtggctaacgaccagagtatcgatctggtggtagacgcaaacaccgttgcttacaacagcagcgatgtgaaagacatcaccgctgacgtactgaaacaggttaaataagtaatgccttcaattcgactggctgacttagcagaacagttggatgcagaattacacggtgatggcgatatcgtcatcaccggcgttgcgtccatgcaatctgcaacaacaggccacattacgtttatggtaaatcctaagtaccgtgaacacttaggtttatgccaggcttctgcggttgtcatgacgcaggacgatcttccttttgccaagagcgcggcgctggtagttaaaaatccctacctgacctacgcgcgcatggcgcaaattttagatactacgccgcaacccgcgcagaatatcgcgccaagcgccgtgattgatgcgacggcaacgctgggtagcaatgtttcagtcggcgcgaatgcggtgattgaatctggcgtacaactgggcgataacgtggttatcggcgcaggctgtttcgtcggaaaaaatagcaaaatcggggcgggttcacgcttgtgggcgaacgtaacgatttaccacgacattcagatcggtgagaattgcctgatccagtccagtacggtgatcggcgcggacggttttggctacgctaacgatcgtggcaactgggtgaagatcccacaactgggccgggtcattattggcgatcgtgtcgagatcggcgcttgtaccaccattgaccgtggcgcgttggatgatactgttattggcaatggcgtgattattgataatcagtgccagattgcacataacgtcgtgattggcgacaatacggcagttgccggtggcgtcattatggcgggtagcctgaagattggccgttactgcatgattggcggcgccagcgtgatcaatgggcatatggaaatatgcgacaaagtcacggtaactggcatgggtatggtgatgcgtcccatcacggaaccgggcgtctactcctcaggcattccgctgcaacccaacaaagtatggcgtaaaactgctgcactggtgatgaacattgatgatatgagcaagcgtctcaaagcgattgagcgcaaggttaatcaacaagactaacgttccgccttgtagttgccattcttttccggcctgtcacattcatacgattgcggcaggccgtgttattattgcctttttgtatatttggacaggaagagtattttgactactaacactcatactctgcagattgaagagattttagagcttctgccgcaccgttttccgtttttactggtcgatcgcgtgctggactttgaagaaggtcgttttctgcgtgcggtgaaaaatgtctccgtcaacgagccgtttttccaggggcatttcccgggcaaaccgattttgccaggcgtgctgattctggaagcgatggcgcaggcaaccggtattctggcgtttaaaagcgttggtaaactggaacctggcgaactgtattatttcgcgggtattgatgaagcgcgctttaagcgtccggtggtgccaggcgatcagatgatcatggaagtcactttcgagaaaacgcgccgtggcctgacccgctttaaaggggttgcgctggtcgacggtaaagttgtgtgcgaagcaaccatgatgtgtgctcgtagccgggaggcctgattcgtgattgataaatccgtctttattcatcctaccgccattgtggaagacggcgctgtaattggcgctaatgcccacattggtcccttttgtattgttgggccgcaggtcgaaattggtgagggaaccgtactgaagtctcatgtggtcgtaaatggtcaaaccaaaatcggccgcgacaacgagatttatcagtttgcctccatcggtgaagtgaaccaggatctgaaatatgcgggtgagccaacccgtgtggaaattggcgatcgtaaccgcatccgcgaaagcgtcaccattcatcgtggtacagtgcagggcggtgggttgacgaaggtgggtagcgataacctgctgatgatcaatgcgcatgtcgcacatgattgtacggtaggtaatcgctgtatcctcgccaacaacgccacgctggcggggcacgtatcagtcgatgattttgcgatcatcggcggtatgacggcagttcatcaattctgcattatcggtgcgcatgtgatggtcggcggctgctccggcgtggcgcaggatgtccctccgtatgtgattgcgcagggtaaccatgcgacgccgttcggggtaaatatcgaagggctgaagcgtcgcggctttagccgtgaagggctggtggcgattcgtaatgcctacaaactgttgtaccgcagtggtaaaacgctcgacgaagcgaagctggaaatcgctgaacttgctgaaaagcatccggaagtgaaggcgtttaccgagttctttgagcgttcaacgcgcggtccgattcgttaatggcggcacagcgtcctttaacgattgccctggtcgccggtgaaacgtccggcgatattcttggcgcaggcttaattcgtgcgctgaaagcgcgcgtacccaacgcccgttttgtgggcgttgcggggccgcgtatgcaggccgaagggtgtgaagcctggtacgagatggaagagctggcggtcatgggcattgttgaagtgctcggacgtttacgccgtttgttgcatatccgcgccgatctgacccgccgttttaccgaactcaagcccgatgtctttgtcgggattgatgcccctgatttcaatattaccctcgaaggtaatctgaaaaaacaagggattaagaccattcattatgtcagcccgtccgtttgggcctggcgacagaaacgcgttttcaaaataggcagatccacccatatggtgttggcttttctgcctttcgaaaaagcgttttacgataaatttaacgtcccgtgccgctttatcggtcacaccatggcggatgccatgccgctggacccggataaaaatgcggcgcgcgacgtgctgggtatcccgcatgacgcccattgtctggcgctactgccaggcagccgtggcgcggaagtggaaatgctcagcgccgacttcctgaaaaccgcacaattgctgcgacagcgctatcccgatctggaagtggtagtgccgctggtgaacgcgaaacgccgcgagcagtttgaaaaaattaaagcggaggttgcgccggatctcgccgttcatttgctggacggcatggcgcgcgaggcgatgatcgccagcgacgcggcgttgctggcctcaggcacggcggcactggagtgtatgctggcaaaatgcccgatggtagtggggtatcgtatgaagcccttcactttctggctggcgaaacgtctggtgaaaacggagtatgtgtctttgcctaacctgctggcgggaagagaattagtcaaagagctgttgcaggaagagtgcgaaccgcaaaaactcgccgaagcgctgttgccgctactggcgaacggtaaaaccagccatgcgatgcacgacaccttccgtgaattgcatcagcagatccgctgtaatgccgatgagcaggcggcagatgccgtcctggagttagcacaatgatcgaatttgtttatccacacacccatttagtggcgggtgtggatgaagtgggccgtggcccgctggtgggcgccgtagtgaccgccgccgtgatcctcgatccggcgcgtccgatcgtcggtctgaatgattccaaaaaattgtctgaaaagcgtcgtctgtcattgtatgacgagattaaagaaaaggcgttaagctggagtctgggacgcgcggaagcgcatgaaattgatgagctgaatattttgcacgccaccatgctcgccatgcagcgcgctgtcgctggtctgcatattgcgccagaatatgtgctgatcgacggcaatcgctgtccggagctgcctgtgccgtcaatggccgtggtgaaaggcgacagccgcgtggcggagattagcgcggcgtctattctggcgaaagtcacccgcgacgcagaaatggcggcgctggatatcgtttttcctcagtatggctttgcgcagcacaaaggctatccaaccgcttttcatctggaaaagttggcccagtatggcgcgacggcgcaccaccgacgcagttttgcgcctgttaaacgcgctctgggacttgtgtcctgattcttgtatcgagaaatctgaagatgtctgaaccacgtttcgttcacctgcgggtgcacagcgactactctatgatcgatgggctggcgaagaccgggccgctggtgaaaaaggcggcctcattaggtatgcctgcgctggcgatcaccgattttaccaacctctgcggtctggtgaagttctacggagcgggtcatggcgcgggcattaaacccatcgtcggggcggactttaacgttcacaacgaactgctgggagatgagctgactcatctgacggtactggcggcgaataatacgggataccagaacctgacgttgctgatctcgaaagcgtatcagcgcggctacggcgcggcaggcccgattatcgagcgcgactggctggtagagcttaaagaaggtttgatcctgctttccggcgggcgcatgggcgacgtaggccgctgtctgctacgcggcaaccaggcgctggtggaggagtgcgttgctttctatgaagcgcattttcccgatcgctacttcctggaactgatccgtaccggcagacaggatgaagagacctatctccatgctgcggttgagctggctgaggcacgtggtttgccggttgtcgcgacaaacgatgtccgtttccttgaaagcgatgattttgacgcccatgagattcgtgtcgcgattcacgacggtttcacgctcgacgatcctaaacgtccacgcaattattcaccgcagcagtatatgcgcagtgaagaagaaatgtgcgagctgttctccgatattccggaggcgctggaaaatacggtggagattgccaaacgctgcaacgtaacggtgcgtctgggtgaatatttcctgccgcagttcccgaccggcgatatgaccaccgaagattatctggtcaaaaaatcgaaagaggggctggaagagcgtctggctttcctgtttccggacgaagaagagcgcaaaaagcgtcgcccggaatatgacgagcgtctggatattgaactacaggttatcaaccagatggggttccctggctacttcctcatcgtgatggagtttatccagtggtcaaaagataacggcgtgccggtagggccgggacgtggttccggggccggttcgctggtggcctacgcgctgaaaattaccgaccttgatccgctggaatttgacctgctgttcgaacgtttcctgaacccggaacgtgtctcgatgcctgacttcgacgttgacttctgtatggagaaacgcgaccaggtgattgagcacgtcgcagacatgtacgggcgtgatgcggtatcgcagattatcaccttcggtacgatggcggcgaaagccgttatccgcgatgtgggccgcgtgctggggcatccgtacggttttgtcgatcgtatctcgaagctggtgccgcccgatccgggcatgacgctggcaaaagcctttgaagcggaaccgcaactaccggaaatttacgaggcggatgaagaggtcagagcgctgatcgatatggcgcgtaagctcgaaggcgtcacgcgtaacgccggtaagcacgctggcggcgtggtcatcgcgccgaccaaaattaccgactttgcgccgctgtactgcgatgaagagggcaagcatccggttacccagtttgataaaagcgacgtggaatatgccgggctggtgaagttcgacttcctcggtttgcgtacgctgactatcatcaactgggcgctggagatgatcaacaagcggcgggcgaagaatggcgagccaccgctggatatcgccgccattccgctggacgataaaaaaagcttcgacatgctgcaacgctcggaaaccacggcggtcttccagcttgaatcgcgcggtatgaaagacctgatcaagcgtctgcaacctgactgctttgaagatatgatcgcgctggtggccctgttccgtcccggcccgttgcagtcagggatggtagataactttatcgatcgtaagcacggtcgtgaagaactctcttacccggacgttcagtggcagcatgaaagcctgaagccggtactggagccgacctacggcatcattctgtatcaggaacaggtgatgcagattgcccaggtactttccgggtatactctcggtggcgcggatatgctgcgtcgtgcgatgggtaagaaaaagccggaggagatggccaaacagcgttccgtttttgaagagggcgcgaaaaagaacggtatcgacggcgaactggcgatgaaaatctttgacctggtggagaaattcgccggttacgggtttaacaaatcgcactccgccgcttatgcgctggtttcttatcagacgctatggctaaaggcgcactatccggctgaatttatggcggcggtgatgactgccgatatggacaacaccgagaaggtcgtcggcctggtagacgagtgctggcggatgggactgaaaattctgccgccggatattaactccggattgtaccatttccacgttaatgatgagggcgagatcgtctacggcatcggcgcgatcaaaggcgtcggcgaagggccgatcgaagcgatcatcgacgcgcgtaatcagggcggctatttccgcgaactgtttgatctgtgcgcgcggaccgacaccaaaaagctcaaccgccgggtgctggaaaagctgatcatgtccggggcgttcgaccgcctggggccgcaccgcgccgcgctgatgaactcattgggcgatgcgctgaaagccgccgaccagcacgccaaagcggaagctatcggtcaggcggatatgttcggcgtactggcggaagagccggagcaaatcgaacaatcctatgccagctgccagccgtggccggagcaggtggtgttagatggggaacgtgaaacgttggggctgtacctgacgggccaccctatcaatcagtatttaaaagaaattgagcgctatgtcggcggggtaaggctcaaagacatgcatccgacagaacgtggtaaagtcaccacggctgcggggctcgtgattgccgcaagggttatggtcaccaagcgcggcaatcgtatcggcatctgtacgctggatgaccgttccgggcgtctggaagtgatgttatttaccgacgcgctggataaataccagcagttgctggaaaaagaccgcatacttatcgtcagcggacaggtcagctttgatgacttcagcggggggcttaaaatgaccgcccgcgaagtgatggatattgacgaagctcgcgaaaaatacgctcgcgggcttgctatctcgctgacggacaggcaaattgatgaccagcttttaaaccgactccgtcagtctctggaaccccaccgctcggggaccattccagtacatctctactatcagagggcggatgcgcgtgcgcggctgcgttttggcgcaacgtggcgtgtctctccgagcgatcgtttacttaacgatctgcgtggcctcattggttcggagcaggtggaactggagtttgactaatacaggaatactatgagtctgaatttccttgattttgaacagccgatagcagagctggaagcgaaaatcgattctctgactgcggtaagccgccaggatgagaaactggatattaatatcgatgaagaagtccatcgcctgcgcgaaaaaagcgtagaactgacgcgcaaaatcttcgccgatctcggcgcatggcaggtagcccaactggcgcgccatccgcagcgtccgtacaccttggattatgtccgtctggcgtttgatgagtttgatgagctggcgggcgatcgcgcctatgctgatgacaaagccatcgtcggcggtatcgcgcgtctggaagggcgaccggtgatgatcattggtcatcagaaaggtcgtgaaaccaaagaaaaaattcgtcgtaactttggcatgccagcgccggaaggctaccgcaaagcgctgcgcctgatggaaatggctgaacgcttcaacatgccgattatcaccttcatcgacaccccgggcgcttaccctggcgtgggcgcggaagagcgtggtcagtctgaagctatcgcccgcaacctgcgtgagatgtctcgtctgaacgtaccggtcatctgcaccgtgattggcgaaggcggctccggcggcgcattggcgattggcgtgggtgataaagtgaatatgctgcaatacagcacctattccgttatctccccggaaggttgcgcctctattttgtggaagagcgccgacaaagcgccattggctgctgaagcgatgggcatcatcgcgccgcgtctgaaagagctgaagctaatcgattccatcattccggagccgctgggcggcgcgcaccgtaatccggaagcgatggcggcgtcgctaaaagcgcagctgctggaagatttagccgatctcgatgtgttaagcaccgatgatttaaaaaaccgtcgttaccagcgtttgatgagctacggttacgcctaatcatttacctcatttctcccaggaggccggataatccggcctcttttttgtctatggaaaaccccagctaggctgggggttccggaaagctttcagctttaagccagttattaaaaccccttttgatttgttaaaacatcttgcggtctggcaactgcaaaagttcaacaagaaatcaaaagggggtcccaatgggggacgaaaagagcttagcgcacacccgatggaactgtaaatatcacatagttttcgcgcccaaataccgaagacaagcgttctatggagagaagcgtagggcagtaggcagcatattaagaaaattgtgtgaatggaaaaacgtacgaattctggaagcagaatgttgtgcagatcatattcacatgcttctggagatcccgccgaagatgagtgtgtcgagtttcatgggatatctgaagggtaaaagtagtctgatgctttacgagcagtttggggatctaaaattcaaatacaggaacagggagttctggtgcagagggtactatgtcgatacggtgggtaagaatacggcgaagatacaggactacataaagcaccagcttgaagaggataaaatgggtgagcaattatcgatcccgtatccgggcagcctgtttacgggccgtaagtaacgaagtttgatgcaaatgtcagatcgtatgcgcctgttagggcgcggctggtaagagagccttacaggcgcatcagaaaaacctccggctatgccggaggatatttattttggacgaggaaaaatgagacgccgatgagctgatgtgattaaacgcaacggcatgttctccctgacactgtagcaactgccaggcgtgtggccagggcaggcagtgaactacccttcaaggagaaaattatgggattgcaaaaaacactggcgctcagcgccgtagcggcagggatcatgttgagcttatccggtgcgcaggccgcgccgctgcttagcagtagtgagccaatgaccattaacgccagcgatctggcggcgaaagagaaagcgctgacggattttccgttaatggaggcagtgaaatcctctatccagacgttggataacagcgcggtcgaacaaatcgaaccggggcgcgccgctaacccggcaaacgtaaaacgcgttgaaagtattctgaaagaggccgaccgggattatctgttcccgatgcgcgcgccggaatacacttactctaacttcctgaaagcgataggtaaattcccggcggtttgtggtacctacaccgatggacgcgatagcgacgctatctgccgtaaaaccctggctactatgtttgcgcattttgcccaggagacgggcggtcacgaaagctggcgtgacattccggaatggcgtcaggcgctggtctatctgcgcgaagtcggctgaacagaagggcaaaaaggcggctacaacggcgaatgtaacccggatgtatggcagggccagacctggccgtgcggtaaagataaggacggcgatttcctcagctattttggccgcggggcaaaacagctttcttataactacaactatgggcctttctctgacgcgatgtatggcgacgttcgccctctgctggataaacccgagctggtggcggatacctggatgaacctggcgagcgccgtcttcttctttgtgtatccgcagccgccgaagccgtctatgctacatgtgattgacggtacctggcagccaaacgatcgcgataaagcaaacggcctggtatcaggtttcggcgtcactattcagatcatcaatggcggcgtggagtgcggcggcgcagatgagaatgcgcagtcgcttaaccgtatcgcctactacaaagagtttgccaactacctgaaagtgccggtgccggctgacgaagtgttgggctgtaaaaagatgaagcagttcgatgaaggcggcgctggcgcgttaccgatctattgggaacaagactggggctggagcgccgatactgcggacggtaaaacctattcctgccagttagttggatatcagacgccgtataccgcctttaaagagggcgactacacgaaatgtgtacagcattatttcaacgttaatgtcgtcgatgataacggaaccactgaaccggatgtcacgccaactccggcgccagtgacggatgaaaacgtggcaccagtcgcgcgcattgccgggccggtcggggcggtggaagccggtagccaggtttcactcaacgcggaaggatcgaccgacgcgaatggcgacaagctcacctatacctggatgtcgcaggatggcaaaacgctgagcggccaggataaagccgttgtgattttcaacgcgccggatgtcactcagaacacccagtatgtggtgaatctgaccgttagcgacggtacgctctccagtacagcggtttatacgctgaatgtgaaagcgaaggccgccgctgcggatgacgaagataagaccaccagctaccctgcctggagcagcagccagaaatggaatccgggcgacatcgtcaacagtaatggcgcattgtaccagtgcaaaccgttcccggaaggctcatggtgtaatgttgcgcctgcctactatgagcccggcgtagggattgcctgggccgatgcatggaacgcattgtaataagataaatcctgtcggtgctttgcatcggcaggattgttactatgcttatctcaggttttttcaggagaaagcatgaacatcatcgccattatggggccgcacggggtttattataaagatgaacccatcaaggagcttgagcgtgcattacaatccctgggatttcaaattatctggccgcaaaatagcgttgacttgttgaagtttattgaacataacccgcgcatctgcggcgttatttttgactgggatgaatacagtctcgacctttgtagcgaaatcaaccagctaaatgaataccttcctctctacgcctttatcaataccaactccacgctggacgttagcgttcacgatatgcgcatggcgctgtggttttttgagtatgcattggggctggctgaagatatcgcgacgcgcattcatcaatatacaaacgaatatctcgataatattacgccgccgtttaccaaagcgctgtttacctacgccaaagaaggaaaatataccttttgtacgccggggcatatggcgggaacggtgtatcagaaaagcccgccaggctgtctgttttatgacttttttggcggcaataccttaaaggccgatgtgtcgatttcggtgactgaactgggatcgctgctggatcacaccgggccgcatctggaagcggaagagtatatcgcccgtacttttggcgccgagcagagttatatggtgacgaacggtacgtcgacctcgaataaaattgtcggtatgtatgccgcgcctgcgggaagtacgctacttattgatcgtaattgccataaatcgctggcgcatttgctgatgatgagcgatgtggtgcctctctggttgaagccgacgcgcaatgcgctcggcattctcggcggtattcctaagcgtgaatttacccgcgacagcattgcgcgtaaggtggcggaaaccgcgcaggcgcaatggccggtgcatgcggttatcaccaattcgacttacgatggtctgctgtataacactaactggatcaagcagatgctggacgttccctcgatccattttgattccgcctgggtaccctatacccatttccatccgatctaccaggggaaaagcgggatgagcggcgatcgggtgcccggaaaagtgattttcgaaacgcaatccacccataaaatgctggcggctttttcgcaggcgtcgcttattcatatcaaaggggaatatgacgaagagacgtttaacgaagcgtttatgatgcacacttctacatcgccgagctatcccattgtcgcctctatcgagaccgcggcggcgatgctgcgcggcaatccagggaaaagattgattaatcgttcggtggaacgggcgctccattttcgtaaagaagtacagcggttacgtgaagagtccgatagctggttctttgatatctggcagccggaagaggttgatgaggccgaatgctggccggtcacgccgggagaaacctggcatggcttcaccgatgctgatgacgatcatatgttcctcgatccggttaaggtgacaatcctgacgccggggatggatgaacagggcaacatgagcgaagaggggatacccgccgcgctggtggcgaagttcctcgatgagcgaggcgtggtggtggaaaaaaccgggccgtataatctgctgtttttgttcagcatagggattgataagacccgtgcgatggggctgctgcgcggactgacggaatttaaacgcgcctacgatcttaacctgcgcgtcaaaaatatgttgccggatctgtatgcggaagatccggatttttatcgcaatatgcgcattcaggatctggcgcaggggatccataaactgatccgccagcacgatcttccggagctgatgctgcgggcgttcgaggttttaccggagatgatcatgaccccgcaccaggcctggcagcgtcagatcaaaggtgaggtggaaaccgtggcgctcgatcaactgccagggcgcgtttccgcgaatatgatcctgccttatccgccaggcgttccgctgttgatgcccggcgagaggatcacgcaacagagtcgggccgtgctcgattttctgctgatgctctgttcgattggccagcattatcccggttttgaaacggatattcacggcgcgaaacggaatgaagacggggtgtaccaggtacgagtcttaaaacacgcctgttagcttgcctgacgagaatgtgacgagtaacgtactgataatcaataaaggagacgctatgctgggattaaaacaggttcatcacatcgcgatcattgcgacagactatgcggtgagcaaggcgttttattgcgatattctggggttcgatctgctaagcgaagcctggcgggaagagcgtgactcgtggaagggcgatttggcgctaaacgggcagtatgtgattgagcttttctcttttcccttccctccggcgcgtccaagccgacctgaagcctgcggtctgcgccatctggctttcagcgtggaaaatgtggaaaacgccgttgcgcatctggaaaagcatcaggttaagtgcgaaccgatacgcatcgatccgtataccgggaagcgctttacttttttcaacgatccggacggtttaccgcttgagctgtatgagcagtaaggcttgtcattaagacgctcgccaggtaacgttgccgggctaagtcactataagcatggatcatgaccactctcacgttgaatacctcgttactctcttctcgccgtattctggctgcctttagcggtggcctggattctacggtgcttctgcatcaactggtgttgtggcgagaacgccatcctgacgtcacgctgcgtgctatccatattcatcacggtttaagccctcatgctgatagctgggtgcggcattgcgaaaccgtatgcgaacgctggcaggttccgctggtagtggagcgggtgacgttggcggataatggcctgggtatcgaggcccatgcgcgtgaagcgcgctaccgggcgttcgcacagacgctattgcctggcgaagtgctggcaaccgcgcagcaccttgacgatcagtgtgaaacattcctgctggcgttaaagcgcggcagcggtccggccggactttccgcgatgggagaacgctcgccttttgccggaactctgcttcttcgcccgctgttgagagaaacgcggaagacgctggaacagtgggctgtgcgtcatggcttatgctggattgaagatgaaagcaatcaggatgacgcctacgatcgcaattttttacgcctgcgcgcgcttccgctcttacagcagcgctggccgcattttcctgcggcggtagcccgtagcgcgacgctctgcgccgagcaagaaaggctgctggacgagcttctggccagcgatcttacggactgtatcacgacggagggaacattgcggctctctccattaatgtcgatgagcgatgtgcggcgggcggcgattttgcgtcgctggctggcgatgcgtaatgcgccgatgccctctcgcgacgcgctggaacgtatctggcaggaggtggcgctggcgcgcgacgatgcctctccctgtttacgctttggcgatcacgagattcgccgttatcagtcgcaactgtggtggattaaaaccgtagccggacaacacgaaacgacggtcgcctggcccgtctggcaaacaccgctggcgctgcctgccggcttagggacggtacagctcgttcctggcggcgaactgcgccgaccgcgagaggaagaatccgtcagcattcggtttaaagcgccagggttgctacacattgtgggacgtcacggcggacgtaaattaaagaaaatctggcaggagcaggggatcccgccctggcgacgagacaccacgccgctgttgttttacggcgaaacgctgattgcggctgcgggtgtttttgtgacgcgtgagggagcagcagaagataaagaaggggtgagtctggtttggcatgcctgatggcgctgcgcttatcaggcctacgtatcgcatggaacgtaggccggataaggtgcttgcaccaccatccggcaacaaaatactcaggattcgctaactaccacggtaccaatttccgggtggctgaaactggcgattttatcgagacgaagttcacaagactcgccggaaacctcggcaagcagatactctacgtttttacgtaagatcaaatcgttcgcttttgcctgcaaaacctcgccatcttttaacgttagcgtcagtattaaatgatgcatgcaggcaagctcaagactatcgtagtcatcgcaattaatgggttgatacgtttcattcattgacataatcgctcaccagtaagttcgcggcagcataagctgccttttccctgaccgactctgaaagggcgctatctgccgccacttcattaagcactttcaatacacaacccagcgcatccgggacataccctaagtctccgctggcgatttccgcataccgcttgcgtactaactcacaatatttttccacatgccctcctgtcagcattctgacttaaccgtggatgcaagtctaagcctacgaagttaaatcttgtttagcaaggtgactataccatactcatttgcgcaatatcagcgcctgacgcgagtgggtaaaagattcgttaacagccttttagcgcggttttcgctacaatgggcgcctgattcgaaaggagttttctcatggcgcttaaagcgacaatttataaagccgtcgtcaatgtggctgaccttgatcgcaaccggtttctggatgcggcattgacgctggcgcgtcacccttctgaaacgcaggagcgcatgatgctgcgcctgttggcatggataaaatatgctgatgaacggttgcagtttacacgcgggctcagcgcggaagatgagccggaggcctggctgcgcaacgatcatctgggcatcgatctctggatagagctggggctgccggatgagcgccgtattaagaaagcctgtactcaggcgagcgacgtcgcgctctttgcttataactcccgggcggcgcaaatctggtggcagcagcatcaaagcaagtgcgcgcagttcgctaacctgtccgtctggtatctggatgacgggcagctggcgcagctcagtgaatttgccgatcgtaccatgacgctacaggcgacgattcaggacggcgcaatctggctttctgatgctcggaataatctggaaatacagctaaccgcctggcaacagccctcatgattgccatctcccggacggtctccatagccgataatgagctggaaattacggccattcgcgcgcagggcgcgggtggtcagcacgtaaataagacctctagcgcgattcatttgcgctttgacattcgggcctctggcctgccagagtattataaacagcgtttgctgacggccagccaccatctgataagcgatgatggcgtcattatcattaaggcgcaggagttccggagccaggagctcaaccgggaagcggctatcgccaggctggttgccgtcataaaagaattaaccgcggagcagaaaagccgtcgcgcaacccgtccgacgcgtgcctcgaaagagcgccgcttgtcctcaaaggcgcaaaaatcttctgtaaaggcgcttcgcggcaaaattcgtcgtccactggattgacgggcaggaatagcaatttcataaggattttatggtgagaacagcaatattgtcagtagcggcagcctgtacgctatttgcattgatagggtgtaataaccgtgcggaagttgacgccctgcaacctgcgcaggcggcggaattaaaacccatgcagcaaagctggcgcggcgtgctgccctgtgcggattgtgaaggtattgaaacgtcactgtttctggaaaaagacggcacatgggtgatgaacgagcgctatcagggcgtgcgcgaagaaccttcctcttttgcgtcatacggtacctgggcgcggacggcggataaactggtgttaaccgacagcaatggcgagaaatcgtattatcgcgcgaaaggcaatgcgctggagatgctcgacagagaaggcaatccggtggcttcgcagcttaattatacgctggtgcctgttaccgccagcctgccggtaacgccaatgccgctgcgtggtatgtatgtatacagggccgatgcggcgacctttaccgattgcgcgaccggaaaacggctgccggtcgccagtaacgcccagcttgagcgcggctatctggcggcgaaaggtgaagcggaaaaaccggtgctgctgacggtcgaagggcattttgtgtttgccgcgaatccggacacgggcgagccggtaaaaacgctaatagctgataaaaatgtgaagtttgcgccgggtaaagattgcactcactaataaatatcctccggcatagccggaggtttttctgatgcgcctgtaaggctctcttaccagccgcgccctaacaggcgcatacgatctgacatttgcatcaaacttcgttacttacggcccgtaaacaggctgcccggatacgggatcgataattgctcacccattttatcctcttcaagctggtgctttatgtagtcctgtatcttcgccgtattcttacccaccgtatcgacatagtaccctctgcaccagaactccctgttcctgtatttgaattttagatccccaaactgctcgtaaagcatcagactacttttacccttcagatatcccatgaaactcgacacactcatcttcggcgggatctccagaagcatgtgaatatgatctgcgcaacattctgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaataaaaggcctcgcagggtgcgaggcctttacatatctgccggatggcgccgggcaatcccaacaaaatgtcgtttagcctttaatcgccttgaccagataatcaacgatatcgccggttttaatcagcgatttttcaccgctacgacggtatttatactcaatatcgtcgttatccaggttgcgatcgccaatcacgatagtatgtggaataccaatcagctccatatcggcaaacatcacgcccgggcgctctttacgatcgtccatcagcacttcaatgccctgcgcgcgcaattcgctgtacagcttttccgccagctcctgcacacggaaggatttgtgcatattcatcggcagaatagcgacctggaaaggtgcaatggcgtcaggccatacaatgccgcgctcgtcaaagttctgctcgatagccgcggcaacgacacgtgttacgccgataccatagcagcccattgtcaggatctggttacggccatcttcaccctgaacggaggctttcagcgcttctgagtacttggtacctaactggaagatgtgacccacttcgataccgcgtttgataagcaacgttccctgaccatccggactcggatcgccggcgactacgttacggatgtcggcaacaacaggcgtcgccacatcgcgatcccagttaataccaaagtagtgtttaccgtcgatgttagcgccagcggcaaaatcgctcatggcggcaacggtacgatcgatgatgaccggaatcggcatattgaccgggccgagggagccagggccggcattaattacggcgcgaatctcttcttcagtagcgaaggtcagcgggctggcaacgtgcggcagtttttccgctttaacttcattcagttcatgatcgccgcgaaccagcagagccaccagcggagacttgctgtctttcaccgctttcaccagcagcgtttttaccgttttttcaattggcaggttgaattgttccaccagctccgcgatggttttggcatttggcgtatcgaccagagtcatttcctgcgtcgccgctgcgcgcggtgtttgcggcgcgatagcttctgccagttcaatgttagccgcgtaatcagaaacatcagagaaaacgatatcgtcttcgccgctttgcgccagcacctggaattcatgcgaggcgttgccgccgatagaaccggtatcggcctgtaccgcgcggaaatccagccccatacggctgaagatacggctatacgcggcgtacatggcgtcataggtttcctgcaacgactcctgagaggtgtggaaagagtaagcatctttcatcaggaattcgcgcgaacgcatcacgccaaagcgcggacgcacttcatcacggaatttggtctggatttggaagaagttcagcggcaactgcttataagagctgagttcattacgcaccaggtcggtgataacttcttcgtgggtcgggccgagtacgaacggacgctcgccacggtcgacaaaacgcagcagttccggaccgtactgttcccaacgaccactctcttgccacaggtcggctggctgaacgactggcatcgacacctcgatagcaccggcgttgttcatctcttcacgcacgatgttttcgacttttttcaggacgcgcaggccggtcggcagccaggtatataacccggaggcgagcttgcggatcatcccggcgcgcagcatcagctggtggctgataacctcggcgtcggcaggtgtctctttcagagtggagagcaggtattggctagtacgcatgttgttacggttccagttgaacgatcgaacaggctcaatgtgagcctgatacaaaaaaagtgatttagtttaccagcgtgcaagagatgtcaaaagagaagggcgtgaaattaccgtggttccagcgcaaacacttcaaatccggtgttaaccacacgccagcgcacgttaaaatcatgcagccagacggcataggttttgcccgtctcttcacccttacgataagccgggcgaggatcttgcgccagcacatcgcaaataaatgtccgtagctgcggataacgcctttccagcgtcgtaagctgttgagccacttcagcggtaaaactcacaggcatttcagctatcggcgcctgttgcgcatagctggcggcggcgtccggtaaggcctcggcaaacggtaaatacggtttgatatccaccaccggcgtgccatccaccagatccagactgcctaatttcagaattacgctctctttccggcactcgataccttttagcgcaacgagcgacatgccaatcggattggggcggaacgtggagcgcgtggcaaaaacgcccattctggcgttaccgccaagacggggcggacgaactgttggccgccagccgccgtccatcgtctgatgaaaaacgaaaagcacccacaaatggctgaacgcttccaggccgcgaacggcatcggcctggttgtaaggcgctatcagatgcagttcgccgcaggcgcttttgaccagaccaggctggcgcggaacggcgaatttttctttatagggggagcgaataacgccgatttgatcaaactgaaagctgctcatttcgccgaaatattcagggcggacccgatacaaaccgcctgacggtagcagcctggcgtgccgctggtaatttcacagctgtgcagcaggacggcgttggctttcattttagatgcattaatctgcatacgcttgcgcgcagttggaatgttaggcggagagtcttgatttgtcgcctggcaggattcgccgctaacctcgccaagatcgcggaaaggtttgccgactaagtcttcagcattggtgtaaatcctgacgggagcggcacgcggcgctttaggtttctccggctccgcttttggcggggttgcggtgctttgaacaggttcaacaggggatctgcttagcatggaacaaccgcccagcatgagtgccaataaacagatcggtaaagcacgcataatatttcctcaatgaatgttctaattgccagatattgaatcaggagcttgcataaatgacaagacgggcaatagcccgtcctgaataatattacagattgtggaatcagcctaaaacttaccagcctttcaccgcgccgccattaaaaactttatttgcggcttcgtacacttcatcagactggtaagcctgaacgaattttttcacattctcggcgtctttgttatcttcacgcgtcacgatcaagttaacgtacggagaatctttatcttcaacgaagataccgtctttcgctggcgtcaggccaatctggctggcgtaagtcgtattgatgaccgctaacgcgatctgagcgtcatccagcgaacgcggcaactgcggcgcttccagctcaacaattttcagatttttcgggttttcgacgatatccagcgaggtaggaagcagactgacgccgtctttcagtttaatcagccctactttttgcagcagcagcagggaacgaccaaggttggtcgggtcgttaggcacagcgacctgggaaccgtccttgagctcatccagagatttgatttttttggaatatcctgcaatgggatagacaaaagtcttaccaacggaaaccagtttgtagccgcgatctttgatttgctgatccagatacggtttgtgctggaaggcattggcatcgatatcgcctttgctcagcgcttcattaggcagaacataatcattaaaggtcaccaattccacgtccaggccgtatttttctttcgcgactttctgcgcgacttcggcaacttgctgctctgcgccaacgattacgccgactttaatatgattcggatctttttcatcctgaccgcaacccgcaagtgccagagaaccaatcagagcacccactgccgcaaaggttttgaatttgaacgccatgcttatttccttaatgagtatttgtgttgtgtttaacgttacttatgcgtgacagccctgacgatgcgatcgccggataactgaattaaataaaccagaacgacaagtaataccagcaccgtattcatcacggtagcattgtatccaatataaccgtactgatagccgatttgaccgaggccgcctgcgccgacggcgccgcccattgcggagtaaccgaccagggtgattagtgtaatggttgccgcattcaccagaccaggcagcgcttccggtaaaaggattttacgtacaatttgcagcggcgtggcgcccatcgctcgcgaggcttcaatcagcccggcagggatctctaacaacgcattttccactatacgggcgataaaaggcgcggcgccgacggtcagcggtacaatcgcggcctgcaaaccaatggaggtgccgacaattattcgggtaaaaggaatcatccacaccaacaggatgataaagggaatcgagcggaaaatattgaccaccgcagagagggagcgatacagcctggcgttctccataatctgccccgggcgcgtaacatacagcaatacgccaaccggcaggccaatcacgaaaccgaagaaaccggagacaaaggtcatcgccagcgtttcccagacgccacgaaccagtaaccacatcattgcctcagacataacccagtacctctactttcacatggtgatcctgcagccaggcaattgcggcttgcgtctcttcttgtgtgccgtgcatttccgttagcataatgccgaacttcacaccgcccgcgtaatccatctgtgcgctgataatattattgttcacgttgaaacgacgcgcggtttcagaaagcagcggggcatccacagactgtccggtgaactccatgcgcagcatcggcacgctgtcagtttccggcgacgctttcaaacgcgcctggtaatcttccggaatgtccagatgcagagtggactgaataaacttctgcgccagcggcgttttaggatgcgagaagacttcgctgaccgtatcctgctcaataagctcgccattactgatgacggcaacgcagtcgcagatacgttttacgacatccatttcatgagtgataagcagaatcgtcaaccccagacgacggttgatatctttcagcaattccagaatcgaacgggtcgtcgcgggatcaagcgcgctggtggcttcatcgcacagcaacacttttggattactggctaacgcgcgggcaatcgcgacacgctgtttctgaccgccggaaagatttgccggatagctgtcgtgcttgtcgccaagaccgactaaatccagcagctctgtgacacggcgtttgatctcttcctttggtgtgttatccagttccagcggcaacgcgacgttgccaaacacggtacgggaagagagcaggttaaaatgttggaaaatcatgccgatttgacggcgagctttggtcaacccggactctgaaagcgttgtcagctcctgaccgcctaccattacgcttccttcagtaggacgttcaagtaagtttacgcagcgaatgagcgtacttttaccggcgccggaggcgccgatgacgccgtaaatttgtccggcagggacatgcaggctgacattgttcagcgcctgaatggtgcgcgccccctgctggaacactttggtaatattcgaaagtttaatcattgattctttattatcgtaatgaaatgagcggaggcattttcgtctgcctaatacggtcaacgccgtcaacagaatggatgttaaggcatccagacgtctaaatcaatcaggctttatacgatgagcactttcttgcctgctgaaacatgcgatactagcgccacttgctttactcaggagctataaaaggtggcaaagtctgtacccgcaatttttctcgaccgtgacggcaccattaatgtggatcacggctacgtacatgaaatcgatgcatttgagtttatagacggcgttattgacgcgatgcgcgagctaaaaaaaatgggctatgcgctggtggtggtgacgaaccagtccggaatcgcgcgcggcaaattcactgaggcgcagtttgaaacgttaaccgaatggatggactggtcgttggcggatcgcgatgttgatttggacggcatctattattgtcctcaccatccgcagggcagcatagaagagttccgtcaggtatgtgattgccgcaagccgcatccaggaatgcttatctcggcgcgtgatttcctgcatatcgatatggcggcttcttatatggtgggagacaagctggaagatatgcaggcggcagcggcggcaaatgtcgggacaaaagtgctggtgcgtacgggcaaaccggtcacggcagaagcagaaaacgcggcggactgggtgttaaacagccttgctgacctgccatcagcgataaaaaagcagcaaaaataagcgttatggataaaagatgagcggttaaaacaaaaatgcatttttccgcttgtcttcctgaaccgactccctataatgcgcctccatcgacacggcggatgtgaatcacttcacacaaacagccggtcggttgaagagaaaaatcctgaaattcagggttgactctgaaagaggaaagcgtaatatacgccacctcgcgacggtgagctgaaagccgcgtcgcacctgctctttaacaatttatcagacaatctgtgtgggcactcgaagatacggattcttgacgtcgcaagacgaaaaatgaataccaagtctcaggagtgaacacgtaattcattacgaagtttaattctttgagcatcaaacttttaaattgaagagtttgatcatggctcagattgaacgctggcggcaggcctaacacatgcaagtcgaacggtaacaggaagcagcttgctgctttgctgacgagtggcggacgggtgagtaatgtctgggaaactgcctgatggagggggataactactggaaacggtggctaataccgcataacgtcgcaagaccaaagagggggaccttcgggcctcttgccatcagatgtgcccagatgggattagcttgttggtgaggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtctacttggaggttgtgcccttgaggcgtggcttccggagctaacgcgttaagtagaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggggggcgcttaccactttgtgattcatgactggggtgaagtcgtaacaaggtaaccgtaggggaacctgcggttggatcacctccttaccttaaagaagcgtactttgcagtgctcacacagattgtctgatgaaaagtgaatagcaaggcgtcttgcgaagcagactgatacgtccccttcgtctagaggcccaggacaccgccctttcacggcggtaacaggggttcgaatcccctaggggacgccacttgcgcggtaatgtgtgaaaggcgttgccatcagtatctcaaaactgacttacgagtcacgtttgagatatttgctctttaaaaatctggatcaagctgaaaattgaaacacagaacaacgaaagttgttcgtgagtctctcaaattttcgcaacacgatgatgaatcgaaagaaacatcttcgggttgtgaggttaagcgactaagcgtacacggtggatgccctggcagtcagaggcgatgaagggcgtgctaatctgcgataagcgccggtaaggtgatatgaaccgttataaccggcgatacccgaatggggaaacccagtgtgattcgtcacactatcattaactgaatccataggttaatgaggcgaaccgggggaactgaaacatctaagtaccccgaggaaaagaaatcaaccgagattcccccagtagcggcgagcgaacggggaggagcccagagcctgaatcagcatgtgtgttagtggaagcgtctggaaaggcgcgcgatacagggtgacagccccgtacacaaaagcgcatatgctgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagccccaccactaagccagtggtgaactccacatacgcatcctttgctgaggagacggttaacggagcgaaagcgacgttcaacctcaaaagaagcagagggggcttagtggtggggtgactgcgtaccttttgtataatgggtcagcgacttatattctgtagcaaggttaactgtataggggagccggagggaaaccgagtcttaaccgggcgttaagttgcagggtatagacccgaaacccggtgatctagccatgggcaggttgaaggttgggtaacactaactggaggaccgaaccgactaatgttgaaaaattagcggatgacctgtggctgggggtgaaaggccaatcaaaccgggagatagctggttctccccgaaagctatttaggtagcgcctcgtgaattcatctccgggggtagagcactgtttcggctagggggccatcccggcttaccaacccgatgcaaactgcgaataccggagaatgttatcacgggagacacacggcgggtgctaatgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacaccgtgtgttgttgggtaggggagcgttctgtaagcctgtgaaggtgtgctgtgaggcatgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacgggttaatattcccgtacttggtgttactgcgaaggggggacggagaaggctatgttggccgggcgacggttgtcccggtttaagcgtgtaggtatgtgttccaggtaaatccggttcactttaacactgaggcgtgacgacgaggcactacggtgctgaagcaacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgacacgtaggtgaagtgatttactcacggagctgaagtcagccgaagataccagctggctgcaactgtttattaaaaacacagcactgtgcaaacacgaaagtggacgtatacggtgtgacgcctgcccggtgccggaaggttaattgatggggtcagcgcaagcgaagctcctgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgtggacccgtgatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgagactttaggtctcctgaaggaacgttgaagacgacgacgttgataggccgggtgtgtaagcgcagcgatgcgttgagctaaccggtactaatgaaccgtgaggcttaaccttacaacgccgaagatgttttggcggatgagagacgattttcagcactgattccggattttcgggaacgaaagataaaagattcgtttccggcaacagaatttgcctggcggcactagcgcggtggtcccacctgaccccatgccgaactcagaagtgaaacgccgtagcgccgatggtagtgtggggtctccccatgcgagagtagggaactgccaggcatcaaattaagcaaaaggctcagtcgaaagactgggccttttgttttatctgtggtctgccggtgagcactctcctgaggaggacaaatccgccgggagcggatttgaacgttgcgcagtaacggcccgtagggtggcgggcagcacgcccgccataaactgccaggcatcagacaagtgaagaagcccgttctgacggacgggcttctttgcgtgtgtggtaactgtaaaaatgtaggcctgataagcgcagcgccatcaggcaacctgcaccgccggatggcagcttcgccttatccggcctacagcaattatcccgcctacgaagctggtgctcttgtagaaccgataagagcacaacccacccaatcgttaacgatgaactatcctttacacgtgcttatataagcagtgaggattttcattggctatcaaaccttttaactaccagcaagacttttccagcattgacttccgccagcagcctgaattgtatcaggttggacgaggagagcagggggggctactggttgaaccctacaaaagcgaaattcttcctttctggcgctataaagatgaagcatcggcgatgaaatccgcagaacagatctaccagttgttcgaagcttaccggcagcaggatgatttcgttggtatggacatggcgcgtaaatttattcagatgggatacacccgcgccaggcgatacgctaactataaaggtggtaaaaagtatgcagaagacggcagcctgaatacacggggtaatgatcctattaaggccgcggcggcaacggttttcaaaggttggtgggataaaatccgtcaggacgaagactatctgaaacggaaacgccagcatcaggcacggtggggataaaaattagcagacaaataattaacactttatttactttttagtctcgcgtaatctgaatctccaaaataaaaggccgattaagcctggcaacaaggagaacagtatggcagaaattattcagcgtatagataaaaacaacgctgaggctccggagatgcggcgacacatatgggctatcgtgggggcctcttccggaaacttagtggaatggtttgatttctacgtctactctttctgctcgctctattttgcacatatcttctttccttctagtaataccactactcagcttttgcaaacggcaggcgtctttgccgccggttttttaatgcggtctatcggtggttggctgtttggacgcattgccgatcgacgcgggcgcaaagcctcaatgttgatttcggtgtgcatgatgtgcatggggtcgctggtgattgcctgcttacctggttacgataccatcggcacctgggcaccggcgctgctacttattgcaaggttatttcaggggctctcggtagggggagagtatgggaccagcgcgacatatatgagtgaagttgcgcttgaaggtcgtaagggatttttcgcgtcgtttcagtacgttacgcttatcggtggccaactactggcattgctggtcgttgtgattttgcagcaggttctggaggatgctgagcttcgtgcctggggatggcgtattccctttgcgctgggcgccgtgctggcggttgtggcgttatggctacgtcgccagctggatgaaacctcgaagcatgagactcgcgcattaaaagaagccggttcgttgaaaggtttgtggcgtaatcgcaaagcctttttgatggtgcttggtttcaccgcggcaggctcgctgtgcttttataccttcaccacctatatgcagaaatatctggtaaatacagcaggtatgcatgccaatgtcgccagcggcattatgacggctgcgctgtgtgttttcatgttggtgcagccgttattcggcgcgttatccgataagattggcaggcgcacctctatgctatgttttggcgcactcgcgacgcttttcaccgttccaattctctccgcgttgcagaatgtgacgtcgccttatgccgcatttgctttagtgatgtgcgcgctattgattgtgagtttctatacctcgattagcgggatcctgaaagcggagatgtttccggcgcaggttcgcgccctgggcgtcggtttatcttacgcggtagcaaacgcgttatttggcggctctgcggaatatgtcgcgctgtcgctaaaatctgtcggtatggagagttcgttcttctggtatgttaccgcgatggccgttctggctttcctggtttcgttgatgttgcaccgtaaaggaaagggcttacgcctttagtatcgcgccatttgccagatagcgtaaccggttgtcgcgccagcgacatcccagacaaaatctttccagctccagccgctgccttccgggcggctgtcccagagttcttttgaggctccgagactcaaagaaaacatcagccctatcgctgcgctgcggtcagggcttactccctggtgacgcgcatactcattaccggctgccgatagcatcgctgatgccataaaatgctgggctttatcctgaccgctccagtggtcgttagccagatggctgcacccggagagaaacaacaccgtaaaaggaatcaacacgcgcaccagttcactcctaagagaaaaccccgtacaggacggggcttcgattacaggatacggctaattaatctgtcgatgcggatccggcgcagacggcgaatcaatttacgcacttttatcggatagtcggcaatgctctgcaggtcacgataatgttttacgatggttgtgtgcgttcggataagttccagctctttttcccgctgaggggcaagctcttgcttaggatcgtggatcagaatggcgttttccagatccagacgccaggcgcgaggattcagattgttgccggtgagtagcatccatttatcatctacccacatccctttcaaatgataggtattgtcgtcatctttccacagacgcaccacaagctgatcggtattgacgtaatactgtaaacggctcaggaagcggcgcaggttaatctcatagagatagggcagcgcgccaatgatcttgaacggttcatcttccggaatgtaaaaatcattcgcggttttatcgccaacaatgatttcgactttctttccgtcgcgcagtagctgaataatattccgcaccagtaccgctggtagattgaagtaaggggtacaaatggtgagcttatgctccgcacagggcatgagatggaaaatggttttgttcagcagactggattttccaagcccgaccagcggcgtaacggagagctgctcgtcattagcgtcaccctgaaaatgatatgacgcatcacgcagctcctgacggtataagcggatatcgtttttaatctccgggcttttcggccgctgggtattatccagacgattcacaccacggccattcatcagattttgcgtcacccagtcaaacatgatgtctgccatttgccgattgcgaatcagctggtagcgatcgtagcgatatttgtcatgctgatggagatagacatcgttcaggctggcgccgctgtacaggacgctatcatcaatgataaagcctttaaaatgcagtacgccaagcgcttctcgcgtattaatcggcacgccgtaaaccgggacatcaatgccggggttttcctgcgccagtcggcaataccagtctgcattggtattcgaggccgctgcgccaatgcgcccgcgttgcgcgcgatgccagtcgaccagcaccctcacgtccagttcaggacgctgccgtttagccgcatagagcgcgtcgagtatacctttacccccatcgtcctgttccagatacagggcaacgatacaaatacgctgcgtcgcgctggcgattttctccagcagtgtctcccgaaaagtagcaggagtataaaagaaatctacatcatcaactgactgagaaatcttagggagttgggcaaggtgttgttgatgtttattacgcttaaattttgacaacatcacagtgcatttcttctctgttcattgaagggtcctctgtgctatgcagacgacataagcgagcaataataacatcagtacccgttaaagtggtcaacatttccagtacattactcacgattcatcacatttggccagattcagcgtcaatcccacgatgccctcgtcgagctgaatatcgacctgaaatcccagttttctggccagcgcgaccatgccgcgattgttcggcatcgtaataccgttcagccgcttcaatccgtgatcgcgagtataggcaatcaatttctccattaaacggcgtcctaaacccaaccctttaagatctgaacgcaccaatacggcaaattcggcatctacgttgtcaggatcggagatcgcgcgcgttacgccgaggatctcttcagcgttgtccatccgcctcacggccacaaaggccatttctcgatcgtagtcgatctgcgtcatgttggctaaatcttcatgggtgaattcgttgatctcgctgaaataacggtagtaaagatcctctttggtgacctgtgcgatgaattgtcgcagttggggctcatcttccggcaggatcggacggaacaggcagcgatcgccgtttttcatctccacccactcttcaagctggtggggataggggcgtaccgcaagacgactttcgttatcgccatcaaacggggcaatatccagcgtcacatccagcgcggtaaactcactggcggaagccagcagcggatggatatccagacgctgaatttccgggcaatcgacaatcaggtttgaaacctggaccagcaattggcttaaaccgacaatatccagcggacgcagcgcgctacgggcgcgaattttccgctgtttaatgccctgaatcaccagatagcgcgccagattcatgttgagcggcggcagcgcgacgacggcctgctcttccggacgccactctacgccgccttcacccaacataatcaaaggaccaaacaccggatcgtgctcgaccaccacacgcagctcctgcgcgccggcgcggttagccatgctttgtaccagcaaaccgtgaatccgcgcctgcggccaggccatctttacacgatcgaaaatggcgttcgcggcctgttgtacctcgcttgcggtgcgcaggtaaagcatgaccccctgaacttcagatttatgcggaatgtcgggcgagcgcagcttgagagctaccggatagcctatctgttcggcgatatgcactgcttcagcgctgtcgctggcaatccaggttgggagcgtgtgcagcccataggcgtgtaaaatcggctgtacttcatgggtatccagtgaagtggcgccttccgcaatcgcccgctgtaacagattatgcgcctcagcggtattggacgtcaggttactcggcaacgctggcgtttcccgcagttgcttctggttacgccggtattccaccatgtgcataaacgcggtaatcgtgccttccggcgtgcggtaggttggtaatccggcttcgctgaacagccgtcttgcttcctgagatgagaactcgccgcaccagtttgtcagcagcgtaacaaacttgcctctggggtggcgcttaatcgtctcgatcagagcatgggcgctttccgtacccggcgcggcagcgctgggagagtggataaccataagcgcgtcaaaatcctgactggcgagcaggatatccagcgttttgacgtaatgttcgctgctggcgtcatcacacagatccagcggattggcaatatcaatgtgcgcgggaagcgtctgccgtagttgcaggcaggtctcttcgctcaatgtcgccagcttgccgttacgcgaccacaactcatctaacgccagcgcggcaggcgcggcgccattgctgatgatcatcagtctgtcgccgtgtagcggacgcatatggctaagtgtttcgacggcggaaaaaagctcgtgcgtatcctggactcgcagcaggcctgcgcgctggatggccgcatcccacgcagggtccattcccgcgctggtattaagtaaacgctgggctgccgggcttcggccgcttttaatcaccagaatcggtttgttacgtgaagcgctacgggcggcggaaacaaaacggcgggcgtcgcttaactgttccagatagagcaaaattgcgctggtcttgctatcgcgcgccagatagtccagtagttcatcgacatcaatatccaggctatcgcccagcgcgataaagtaggaaaagcccatttcacgctgttgcgcccagtcaagaatagtattggacacggcggcagactgggaaataaaagcgagcttgccctgtttaatcgggacgggagaaaagctggcattcagcccttgccacggcgcgaggagcccaagactgtttggacccagcagacgcattttataatgccgggcactggcaagaagttcttcatgttgcgacgtgggagcagaaaggataatgcacgttttacaacctttcgcgccaagcgcgtccagtaacgccaggttacggctggcgttagtgcataaaatagccagatcgggggtgaaaggaagactggcgatatccggccaggccatgacgcctaaaacggctttccaggcgggcgtcacgggaaggacggggccattgaatccgcccgccaacaagttacgcatcatcaggtaacccgcgcggtggggcttcattgatgcgccaatcaccgcgatcgattttggtcgcagtagcgcttccagtccttgctggctcataccggtttcccttacacagaagtgaccggataattttaaacgctttcgctattttatgctgtgacgtttcccggatgttgcgtttttcctgccagatagcgcgttttgaaacggatgaaatgttcacctaaactggttgccgcctcgggatctcccgccagatctaacaacgctatcgcgacttcggcggtacaatattgcccttcggcatggatttcacgcagacgataagctgaaagacgcgataaatcgacggaaatgaccggcagatgatccagataagggcttttacgaaacattttacgtgcttcgggccaggtgccgtccagcataataaacagcggcggtttcccggcgggcggggtggaaatgacctcgcgcgcttcgccggcgtaggacgcaggaaagaccactatcggctgataatccggatgctgtaccagctccagcaacgcctgcggcggctcggtacgcgaccactgaaacgccgcggtatctggcaaaatatcggctatcagccggccggtattgctgggtttcatcggttcagtgtcaaacatgaccagacaaaaacggcttttcgcctgagaaggcgttaacgtatcacacaggcaagattttagcggcagcaggcagcgttgacagcggcgaacccgattgcctctggcaagaaaagggcgagtagcgcgcgcaagccgttcggcgcgtaactgaaggacagcgttattggtcatagaaagcgtttgcggagaaaaacgctattgtggcagaggtgaaaacggggcacaagatgcgccccgtggcgtttacagcgcttcgttcagccagctgtcgaaaggcgctttaggcactgcgccattaagcatatcgaccacctgtccatgtttaaaaatcataatcatcgggatgctgcggataccgaaacgagcgctgagttcccgttccgcctcggtatttactttgacgaaacggactttaccgctgcgctcttctgcgacatcctcgaagattggcgcaaagttacggcaagggccgcaccagggtgcccaaaagtcgatcaccactggaagatcgtccttcaacagtttgtccagcgtttcgccggtcgcattaatgacttctccgtcaaacaactcatgaccgcagcgtccacattttgccgcgtcctgaagccgatcgccggggatgcggttaatggcctgacaatgggtacaaacggtgttcatagctaacctctgaatacgtcggaagacgtcccgctacgcgcgggatgtttctataatgttatatattatcgaggagtctgtgctaaacaacaatgtgttttattcaatgagtacaatagtcgcaagcttttaaacgaaatcatggctaaccggatgcacatcgggtaatcttcgcgcttcgcgcagcgctggtggagaaaagcatgaacgatgaattaaaaaacaaaagcggcaaagtcaaagtgatgtatgtccgtagtgatgatgactctgataaacgcacccataacccgcgtaccgggaaagggggaggccgcccagcaaagtctcgcactgacggtggacgtcgccccgcccgtgatgagcgaaataatcagagccgtgaccgtaaacatgaaacttcgccgtggcgcaccgtgtcccgcgcgccaggcgatgaaacgcctgagaaagtcgatcatggtggtattagcggtaaaagttttatcgaccctgaagttttgcgtcgccagcgtgcggaagagacgcgcgtctacggcgaaaatgcctgccaggcgctattccagagccgtcctgacgccatcgtgcgcgcatggtttatccaaagcgtaacgccgcgttttaaagaggcgctgcgctggatggcggcgaatcgtaaagcctaccatgtggtggatgaagccgaactggcaaaagcttccgggactgagcaccacggcggcgtgtgtttcctgattaaaaagcgtaacggtacgaccgttaagcaatgggtaaagcaggcggcggatcaagactgcgtgctggcgttggaagatgtcgctaacccgcataatctgggcggcatgatgcgtagctgcgcgcacttcggcgtgaagggcgtggtggtacaggatgcagcgttgctggagtccggcgcggcgattcgtaccgcggaaggcggggcggaacatgtccagccaatcactggtgaaagcattgttgacgtactggatgactttcgtcaggcggggtacaccgtggtgacgacgtccagcgatcgcggtcaggcgctctttagtacgaccctgccggaaaagatggtgctggtcttaggccgtgaatatgactacctgccggaagcggcgcgcgaacccgacgatctgtgcgtgaaaattaacggcaccgggaacgtggaaagcctgaatgtgtcggttgcgacaggcgtactgctcgccgagtggtggcgacagaataaagcgtaagggctgcagcccggtgacgcaacgcgcgccgggccaatgatgtactttctaccgcccggtcagacaaggcgctttcgcgccgttatccgggcgataaaacggcgagtcgccaacgttattcactctcagccggtaatactggcgtccagtcgatagttttctcgccgtgttgttccagccattggttcgttagcgcaaaatggttacagccaaaaaatccgcggtgcgcagagagtggcgagggatgcggagctttcagaatatggtggcgctgtggatcaataatcgcgcctttcttctgggcgtgcgagccccacagcaggaagacgaccccttcgcggtgttggttaatcaggcttatcactttatccgtaaaggtttcccaccccaggctggcatgagagtgcgcctggcctgcccgtaccgtgagcaccgtattcagtaacagtacgccctggcgcgcccagctttccagataaccgtgcgcggggcgaacaaagccgggaatggaggcttccagctctttgtacatattcactaatgacggcgggggagcgatcccaggacgcacggaaaacgccagaccatgtgcctggccggggccgtggtaaggatcttgtcccaggatcaccaccttaacgtcgcccagttccgtgaagcgaaaggcgttaaatacatctttttgcggcgggtagaccgtgatacccgactgacgctcgccagcaacagtgtgaagcgtattgataaagtaaggttgctgtttctcatcagccagcacatcgtgccaggttaactcagtcgccatctcgctctcctgcgaatttccagttcccttagcttaactgcttctttctgcagtgcaaaatcctgcgtgctacaaaaacggttacctacaaaagatagttgaaaatttatgtaaaaagtttataggtctgaatggtgtaagttgatgtaaaacaataaattcccttcatcaccctttttatggtgtggtttttattgatttaaatcaaagaatgaagggtgatcgaagggtatatatacactcaagcaacaatggttttaccaattggccgggattaggccgaccgaaatcaaataattttgcctggggaggcatcacatgattacaggtatccagattactaaagccgctaacgacgacctgctgaattccttctggctgctggacagcgaaaaaggcgaagcgcgctgcatcgttgcaaaatccggctttgctgaagatgaagttgtggctgtcagcaaactgggcgagattgaataccgtgaaattccgatggaagttaaaccggaagtacgcgttgaaggcggtcagcatctgaacgttaacgttctgcgtcgtgaaactctggaagacgcggttaagcatccggaaaaatacccgcagctgactattcgtgtttctggttatgcggtgcgttttaactccctgacgccggaacagcagcgcgacgttatcgctcgtacctttaccgaaagcctgtaaggcttatccggtaataacaagcggaagaggccgggccttttccgcttttgttttatttgtgtcagtaaaaaatccgcaccgcgcagtacaccagcagtaacgccagaatgatatttaactggcgaccataatggcgaaacgcccgctgaaacagatgtcccgccagcgcccagcacacattaccgaacgtgccgatcaatgccagcaatatactgacgccgatgacccagttcagcgcctgcgtttgcggtaaaacaaatgtagacagagcggtaatgccgtacagaataattttgacgttcacaaactgcaggccaaagcttacccaaaagccaaccggttttggtctgaccttctcatccgccgctggactggtggcaattttccacgccagccacaggatatacgcagcccctacccaactgagcaaatgaatgattgccggatcgataaccgcaagggaaaacgcgatcccggcgcacagcagcatgacgaccaaaaatcccagactcatacctgccagtacacgaatactctgccgaaaaccatgtgcagttgctgcgctaagcgcgagaatattgtttgggccgggggtaagggcggtgattaatgtataagtccagaaagcgcttaaaagcatcggtgtcacttgtcatctcctctgttttagcagacagtacccgatatgaaatatttaaaaaaatgaatgttttttaattctgaattcgagattttcgataggttggtggttatggatctgcgtcggtttattacgctgaaaacggtagtggaagagggctcgtttctgcgggcttcgcaaaagctgtgctgtactcagtcgacggtaacttttcatattcaacagcttgaacgtgagttttccctgcaactgttcgagaaaatagggcgccgaatgtgcctgaccaatgaggggaaaaagctgataccgcatatccatgaactgacgcgtgtgatggagtcgattcgtgaagccgcaagacaggatgcggaacccggcggagagctgcgcgtggcgacaggtgaaaccttactggcatacaaaatgccgcaggttttacaacgttttaagctgcgagcgccgaatgtcagattgtcgctacagtcgctgaattgctatgtgatacgtgatgcgttgctgaatgacgaggtcgatctgggcgttttttatcgcgtaggtaatgatgacgcgctcacgatgcagcaactgggggagcagccgctggcgctggtggcctctccactgctacaggatgctgattttacgcagccagatcagcatatccctgcagcttcatcatcaatgaaccgcaatgtgtcttccgccagctatttgaaagtacgctacggcagaggcggattacgctggaaaacaccattgaactgtggagtattgaaagcattaaacagtgtgtggctgctaacctgggcatcagctttttaccgcgatttgccgttgaacgagaacttagcaccggtcagttgaaagagctgccgtttggcgcgccgtcgctatcgatcatggcgctgtgcgcccatcatgccgggaaagcggtcagcccggcaatgcagatatttatgcagtgtatggaggcgtgttttaccgtggaagataaaaaatgccgggttaacgaacccggcattatcatcactcttcgctggattgctcctgcattttcgtaccgcttggcttgcggcgcttaccgatattttttgtatcgcggtaacgtttcttcacgcgcggcttctctttttctttctcttttttcttctcggcgcgtttcgccagcacttttttcgacggtttgccggtcagcttttcgctgggcgcacgcgtggtcgggcgaagctcatcaatgacgcgcgcttttagcggctcttcgatgtagcgaccgattttcagcagcaacagatggtcgtgggcttcaaccagcgagattgcagtgcctttgcgacccgcacggcctgtacgaccaatgcgatgcagataggtatcgccactgcgcggcatgtcgaagttaatgacgtggctgacgtcaggaatatcaatcccgcgtgccgcgacgtcggtcgcgaccagcacgttaacgcgaccgtcggtgagacgcttaataccctcgttacgtttgatctgcgccatctcgccttcaagatagcaattgttgatccctgccagacgcagcgtttcagccagttcatggacgcgttcacgtttacgtacaaacacgatagaacgggttgcatcgtcttgttttagcaggtgcttcaacagcgcaactttatgttcgaaattgtcggcacggtagtaccactggtgaattttcttgcgctcgcgggttgacggattggcggaaacctcaaccgggtcttccagcaggcgctcggcaaaatctttaatcgcatcgccttccagcgtggcggagaacagcatcgtctgtttacgccagcgggtctcaccagcgatatgttcaatgtcctgagcgaagcccatgtcgagcatccggtcagcttcgtcaaggatcagtgtttcaaccgcccggcagtcaaaattctcttcttttatatattgcagcagacggcccgtcgtggcgaccacgatatcctggttttcgctaaacacttcagcatggttcatataggccacgccgccggtaatcgtggcgatatccagatgagtatgcttagccagttcacgagcgtgatcggcaacctgcattgccagttcgcgggttggcgtcaggatcagaatgcgcggcggccccgattttttacgcggaaagtcgagcaggtgctgcaacgccggcagcagatatgccgccgtttttccggtgcctgtcggcgcagaaccgagtacatcacggccatcgagcgcaggcggaatggcggcagcctgaatggcggtcgggcgagtgaaacctttatcctggagggcatccagcaggctttcgtcgagttcaagttcggaaaaagtcgttacagtcatgttctacctctgtgtggggcgctgattatagacgttacggccgcaatcttcatctgtttgtatggatatcccttctcaggtattgttttcactcggcgctgtcgccgttttttgcaaggttgtttttacatgtctcagtctggctccgttcttcgtcgtaacggatttacgtttaaacagttttttgtcgcacacgatcggtgtgcgatgaaagtgggaactgacggtattttactcggggcgtgggcgccggtcgcggatgtaaagcgaattctggatatcggtactggaagcggtctgctggcgttaatgctggcgcagcggacggatgacagtgtgcctgttgacgccgtggaactggatgccggggctgccatgcaagcgcaggaaaacgtggctcactctccatggccgcatcgaataacggtgcatactgacgatattcagcgttgggcgcctcgccagacggtacgctttgatcttattatcagcaacccgccttattacgaacccggtgtggaatgctccacgccgcagcgggagcaggcgcgttacaccgctacgctggatcaccagacgttattggctattgcggcggattgtattaccgaagatggctttttttgcgtagtcttgccggaacaaataggtaacgcttttacgcagcaagcgctcaacatgggatggcatttgcggttacgtactgacgttgcggaaaacgaagcgcgcttgccgcaccgggttttgctcgcattctccccgcaagccggggagtgctttagcgacagattagtaattcgcgggtcagaccagaattattctgaaagttatacggcgctgacccaggcattttatctgtttatgtgaggcgttaacggcgaaaggatcgatgggcctgattcagccagttgttgcggataatccagcgtaaagtgcagcccccggctctctttacgcatcatcgcgcaacgcacaatcagttcggccacttgcaccagattgcgcagctccagtaaattattcgagacgcgaaagttggcgtaatattcgtcaatctcttgttgcaacatagtaatacgccgtagggcgcgctccagccgtttcgtcgtgcgcacaatccccacatagtcccacatcagcagacgcagttcgtgccagttatgctgaatcaccacccgctcatcggcgttctccacgcggctttcatcccaggcgggaaggacgtcaacgctgtggacagaaggcattcgcctgtcgatatccattgccgcggaccagccgtacactaagcattccagtaacgagttggacgccatacggttagcgccgtgcagaccggtgtaactgacttcgccaatggcatataagccgtctacatcggtacgaccataatcatcgacgaccacgccgccgcaggtatagtgcgcggcaggaacaatgggaatcggttctttggttaaatccatccccaaatcgagcagtttcgcatagatcatcgggaagtgctggcggacaaaatcgtcaggcttgtggctgatatcgagaaacatacagtctgcgccgagtcgtttcatctcatgatcaatagcgcgggcgacaatatcgcgcggcgccagttcgccgcgttcgtcaacgtccggcataaaccgtgaaccgtccggacgtttaaggtatgcgccttcgccgcgcagcgcttcggtaaggagaaaattacgcgcctgcgggtgataaagggcagtgggatgaaactggttaaattccagattagcgacccgacagcccgcgcgccaggccatcgcgataccgtcaccggaggaaatatccgggttagtggtatattgatacacctttgaggcgccgccggtcgccagcaccaccgacttcgcatgacaggtttcaacccactctttattgcgattccagatccaggcgccgacgacccggcgaggccccggcagacctattttatcggagataattaaatcaacggcgttgctgcgttccagcacctgaatattaggatgattttgtgcccgactgaccaacgtggtttcgacttcctttccggtagcgtcggcggcatgaaggatacggcgatggctatggccgccttcacgcgtgagatgatagctctccttgccgtttggctggacatgcgtatcaaacaggacgccctgatcgataagccactgcacgcaggtacgagcgttgctggcgacaaactccaccgcgtggcgatcgcaaattccggcgccggcaatcagcgtatcttcgacatgcgatgcaatgctgtcggtttcatcaaacacggcggcaataccgccctgtgcataaaacgtggagccctcgctcaccggccctttactcaggacgataaccttatgcttttcagccagacgcagcgccagcgagagtccggccgcgccgctgccgataattaacacatcacaggacagttcaggagttgtcatcatggttcttgtttaatttactaaacatggttgcggcagattagcactatatggcgctaaaaagcacgttatgatttcaaaagtgttgtgcttattaaacataaaataaaaatacggcgagagataaacggcaaaaaatattttatagggcagggtgttagcgtcggattttgtagtgaaataaagatgctgttaggttactctgcaaacgacgaaatgggcatttctgtacagatagtgcgttgttcagcatctgtagacttataatggaagataagacctgtctacaacatgacaaacaaaaacaaatgcgtaacggaactttacgaaacatagacactctaacctgttgcttgctcatagtgcggcttatggagtggcgtttcgaaagcgcgtggaaatttggtttggggagacattacctcggatgagcgagcagttaacggaccaggtcctggttgaacgggtccagaagggagatcagaaagcctttaacttactggtagtgcgctaccagcataaagtggcgagtctggtttcccgctatgtgccatcgggcgacgttcccgatgtcgtacaggaatcatttattaaggcctatcgcgcgctggattctttccggggggatagcgctttttatacctggttgtatcgtattgcggtcaataccgcgaagaactacctggttgcgcaggggcgtcgtccgccttccagtgatgtagacgcgattgaagcagaaaactttgaaagcggcggcgcgctgaaagaaatttcgaaccctgagaacttaatgttgtcagaagaactgagacagatagttttccgaactattgagtccctcccggaagatttacgtatggcaatcaccttacgggagctggatggcctgagctatgaagagatagcggctatcatggattgcccggtggggacggtgcgttcacgtatcttccgggcgcgggaagctattgataataaagttcaaccgcttatcaggcgttgacgatagcgggatactggaaaaggtattaggcatgcagaaagaaaaactttccgctttgatggatggcgaaacgttggatagtgagctgctcaaagcgcttacgcacgactcggaaatgcagaaaacctgggagagttatcacctgatccgcgattcaatgcggggggatacgcctgacgttctccatttcgatatatccgcccgcgtgatggccgctattgaaaacgagccagtacgtcaggtgacgccattaatccctgaggcccaacccgctccgcagcaatggcagaaaatgccgttctggaaaaaagtgcgtccgtgggcggcgcagcttacccaaatgggcgtggcggcgtgcgtttcacttgcagttatcgtcggtgtccagcactataatgggcaatctgaaacatcccaacaacctgaaacgccggttttcaataccctgcctatgatggggaaagccagcccggtaagtctgggagtgccttctgaagcagcgcctgtcggcagtcagcaacagcaggtacaggagcagcgtcgtcgcattaatgccatgttgcaggactatgaactgcagcgccgactgcactccgaacagcttcagtttgagcaggcgcaaacccagcaagccgcggtacaggtgccaggaatccaaactttaggaacgcaatcgcagtaatgaagcaactttggtttgccatgtcccttgtggcggctagcctgttcttctcagtaaacgcctcggccgaccctgcgtccggggcgttattgcagcagatgaacatcgccagtcagtcactgaattacgagctgtcattcgtcagcatcacgaaacaaggcgttgaatctctgcgttatcgacacgcacgcctggatagtcgcccgcttgcgcaattgctacagttggacggtccccgccgggaggtcgtacagcgtggtaatgaaatcagttattttgaaccgggccttgagccgttcaccctgaacggtgattatattgtcgattctctgccttccctgatttacaccgatttcaagcgtctggcgccttactacgactttatttccgtcggacgcacccgtatcgcagacagattatgcgaagttatccgcgttgtggcgcgcgatggtacgcgttacagctatatcgtctggatggacatggacaccaaactaccgatgcgcgttgatctgctggatcgcgacggcgagacgctggagcagttccgcgttattgcgttcacggtgagtcaggatatcggcagcaccatgcaggcgctggcgaaggcgaatctgccgccgctgctttctgttcccggtggcgaaaaaacgaaatttaactggaatccatcctgggtgccgcaaggctttagcgaagtttccagcagccgtcgtccgttgccgacgatggataacctgcctatcgaatcgcggctttattctgacggtctgtttagcttttccgtcaatgtgaaccgggcgacgcaaaacagcagcgatcagatgctgcgcaccgggcgccgaacggtttatagcagcgttcgcgacaacgcggaaatcaccattgtcggagagcttccgccgcaaacggcgaagcgcattgccgacagtatcaaattcagggcagtacaatgattaaagagtgggcaaccgttatctcctggcagaatggtcaggcggtggtgagctgcgacgttaaagcgtcatgcagcagctgcgcctcccgtgcgggatgcggcagtcgcgtgctgaataaattagggccgcaaaccacgcataccattgttgtgccaagcgcggagccgctggctccggggcagaaagtcgagttgggcatcgccgaaaaaagccttttaggttcggcgttgctggtctatatgtcgcctttagcggggctatttctttgtgcggcgctttttcagatgctgtttggatctgaccttgccgcattaagcggggccgtgctgggcggagtgggcggttttctggttgcccgcggctattcccgaaaactggcggagcgcgacgcctggcagcccgtgattttaaacgttgccctcccgcctgaccttgtccgcgtcgaaactacctcaatcgaaacgcgccagtaaacgttttgcccaatggtacatggtacacctgccgcgttgggttgttgtcccgataagcatgcgcttttcctgcgttgcggtgttttacaggaaaaaagcgaggcgttttccagttcccgctctccttacactatgaacatttcctcgccttagcgttgtagtgtagaatgcggcgtttcagttaaaacagacgttaagctcagaacagcgacctctaaagtctggtcaaccaggcgtaaggcataataatttatctctatgaagaacatacgtaacttttcgatcattgctcacattgaccacggtaaatcgacgctgtctgaccgtattatccaaatctgcggtggcctgtctgaccgtgaaatggaagctcaggtacttgattcgatggatcttgagcgtgagcgcggtattactattaaagcccagagtgtgacgctggattttaaagcgtctgatggtgaaacttatcaactgaactttatcgacacgccgggacacgttgacttttcctatgaagtttcccgttcgttagccgcctgcgagggcgcgctgctggtggtggatgccggccagggcgtagaagcgcaaacgttggcgaactgctacaccgcgatggaaatggatcttgaagtggtgccggtgcttaacaagattgacctgccggccgccgatccggagcgtgtggcggaagaaatcgaagacattgtcggcatcgatgcgacggacgcggtacgctgctccgccaaaacgggtgtcggcgtgacggacgttctggaacgcctggtgcgcgatatcccgccgccgcaaggcgatccggacggcccgctgcaggcgctgattattgactcctggttcgataactacctgggcgtggtatccctggtgcgtattaaaaacggcaccatgcgtaaaggcgacaaaattaaagtgatgagcaccgggcagacctacaacgctgaccgcctggggatcttcacgccgaaacaggttgatcgtaccgagctgaagtgcggcgaagtaggctggctggtctgcgccattaaagatatcctcggcgcgccggttggcgataccttaacctcagcgcgtaacccagctgaaaaagcgttgccgggctttaagaaggtgaaaccgcaggtctatgcaggtctgttcccggtcagctccgacgattatgaaagtttccgcgacgcgctcggcaagctgagcctgaacgatgcctcactgttttatgaaccggaaagctcctcggcgctgggctttggtttccgctgcggcttcctcggcctgttgcacatggagatcattcaggagcgtctggaacgcgaatacgatctggatctgatcaccactgcgccgaccgtggtttatgaagtagaaacaacggcgaaagagactatctatgttgatagcccctccaagctgccgccgttgaataacatttatgaactgcgcgagcctatcgccgaatgtcatatgctgttaccacaagcctatttaggtaacgttattacgctgtgtattgagaaacgcggcgtacaaactaacatggtgtatcacggtaaccaggttgcgttgacctatgaaatcccgatggcggaagtggtgctcgacttctttgaccgtctgaaatcaacgtcgcgcggctatgcgtctctggattataacttcaagcgcttccaggcttccgatatggtgcgtgttgatgtgttaatcaacaacgagcgtgtcgatgcgctggcgctgatcacgcaccgtgataactcgcaaagccgtggtcgcgagctggtggagaaaatgaaagatttgattccacgccagcagtttgatatcgcgattcaggcggcgattggtacgcatattattgcccgttcgacggtaaaacagttacgtaaaaacgtgctggcgaagtgctacggcggcgatatcagtcgtaagaaaaaactgctgcagaaacagaaagaaggtaagaaacgcatgaagcagatcggtaacgtcgagctgcctcaggaggcgttcctcgccattctgcatgtcggtaaagacaataaataatccctaaggagttggcatggcgaacatgtttgccctgattctggtgatagccacactggtgacgggcattttatggtgcgttgataagtttgttttcgcgccaaaacgtcgggcgcgccaggctgccgcgcaaacggcgtcgggagatgcgctggataacgctacgctcaataaagtggcgcctaagccgggctggctggagaccggggcgtcggttttcccggttctggcgatcgttctgatcgttcgttcatttctttatgaaccctttcagatcccgtcaggctcaatgatgccgacactgcttatcggcgattttattctggtggaaaaatttgcctacggcattaaagatccgatctaccagaaaaccctgattgaaaccggtcatccaaagcgcggggatattgtggtatttaaatatccggaagatcctaagttagattacatcaaacgcgccgtcggtttgccgggcgataaaatcacttatgatccggttgcgaaagaggtgacgattcagcctggctgtagctccggtcaggcgtgcgaaaatgcgctgccggttacctactctaacgttgagccgagcgattttgtacagacctttgcccgccgtaacggcggagaagcgaccagcggtttctttgaggttccgctaaacgagacaaaagaaaacggcattcgcctgaccgaacgtaaagagacgttaggcgatgtgacccaccgcatcctgatggtgccgatagcccaggatcagttgggcatgtattaccaacagccaggacaaccgctggcgacctgggttgtaccgccggggcaatatttcatgatgggcgacaaccgcgataacagcgcggatagtcgttactggggatttgttccggaagcgaatctggtcggtaaagcggtcgctatctggatgagctttgacaagcaggaaggggagtggccgacaggcgtacgcctgagtcgtatcggcggtattcactaactgtggcgaaatgatcgttcacgctgtcgtctttttagcggcagcgtgaattatttcctggataaattccctcagactaacgacatcccctgtcgttgtgtatagaatattcccccgaagttttaggttggcgccgtttggtcgccacggcacacgaaacagcgttggttatagacaaccttctttccgctgcagcgatgcggcaggacagatgacgtgtatcaggtctgtttcgtgtgctggattgttgacgcattcatttattggtatcgcatgaaccccatcgtaattaatcggcttcaacggaagctgggctacacttttaatcatcaggagctgttgcagcaggcattaactcaccgcagcgccagcagtaaacataacgaacgcctggagtttttaggcgattcaatcctgagcttcgttatcgctaacgcgctttatcaccgttttccacgggtggatgagggagatatgagccgtatgcgcgccacgttggtacgtggtaatacgctggcggaattagcccgtgaatttgatttaggcgagtgcctgcgtttagggccgggcgaattaaaaagcggcggatttcgtcgggagtccattctggcggacaccgtggaagcgttaatcggcggagtatttctcgatagcaatatccagaccgtcgagcagttaatccttaactggtataaaacccgtctggatgagataagtccgggcgataaacaaaaagatcctaaaacgcgcttgcaggagtatttgcagggtcgccatctgccgctgccatcttacctggttgtgcaggtacgcggcgaggcgcacgatcaggaatttactatccactgccaggtcagcggcctgagcgaaccggtggttggcacgggttccagccgtcgtaaggcggagcaggctgccgccgaacaggcgctgaaaaaactggagttggaatgagcaccgacaaaacttactgcggatttattgccatcgtcggacgtccgaacgttggcaaatccaccttgctgaacaaactgctcgggcagaagatttcgatcacttcccgtaaagcgcagaccacgcgccaccgcattgtcggtattcataccgaaggcccgtatcaggcaatctatgtcgataccccgggactgcatatggaagaaaagcgcgccattaaccgtttgatgaataaggcggcgagcagttcgattggcgacgttgagctggtgattttcgttgtagaaggcacccgttggacgccggacgacgaaatggtcctgaacaaactgcgcgatggcaaagcgccggttattctcgccgttaacaaggtggataacgtgcaggaaaaagccgatttgctgccgcacctccagttcctggcaagccagatgaactttcttgatatcgtccccatctctgctgaaacgggtatgaacgtcgataccattgccagtatcgtgcgtaaacatttaccggaagcgattcaccacttcccggaagattatatcaccgatcgctctcagcgctttatggcgtctgaaatcattcgtgaaaagctgatgcgttttctcggcgccgagctgccgtattccgttaccgttgagattgaacgttttgttaccaacgaacgcggcggctatgatatcaacgggctgatcctcgtcgagcgcgaagggcagaagaagatggtgattggcaacaaaggcgccaaaatcaaaaccattggtattgaagcgcgtaaagacatgcaggagatgtttgaagcgccggtacacctggaactgtgggtgaaagtgaaatccggctgggccgatgacgaacgcgctctgcgcagtctcggttacgtagacgatctgtgagttaacacagcgtggaagggtggcagcgcgcatttgtcctgcacagtcgcccctggagcgaaaccagcctgatgctggacgtcttcacggaagaatcggggcgcgtgcgccttgtcgccaaaggcgcgcgatctaaacgttccaatctgaaaggcgcgttgcagccttttacgccgttattgctacgctacagcggacgcggcgaggtgaaaaccctgcgcagcgccgaggcagtttctctggcgctgccgttaagcggtattacgctctatagcggcctgtatatcaacgaactcctctctcgcgtactggaatatgaaacgcgcttctccgaactcttttttgattatctgaactgtattcaggcgctggcgggaaccaccggctcgcctgaaccggcgttgcgacgtttcgaactggcgttgctgggacatctggggtatggcgtcaatttcacccactgtgcaggcagcggcgaacgggtggatgacaccatgacctaccgttaccgcgaagaaaaaggctttttcgccagcgtcgtcatcgataacaacacctttaccggacggcacctgaaagcgctggaggcgcgggaatttccggatgtagataccctgcgtgccgctaaacgctttacccgtatggcattaaagccgtatcttgggggaaaaccgttaaaaagccgggagctgttccggcaatttatgcccaaacgcacagtaaaaacgaagaaagattaacgaggattgtcatggctgaattactgttaggcgtcaatattgaccacattgccacgttacgtaatgcgcgcggcaccgactatccggatccggtacaggcggcgtttattgctgaacaggcaggcgcggacggcattaccgtacacctgcgcgaagatcgtcgccacattaccgatcgcgatgtgcgcattctgcgtcagacgctgcatacgcgtatgaatctggagatggcggtgaccgaagagatgctggcgatcgccgtagaaaccaggccgcatttctgttgtctggtgccggaaaaacgccaggaagtcaccaccgaaggcggcctggatgtggccggacagcgcgataaaatgcgtgatgcctgtgcgcgcctagcggcggctggcatccaggtttcgctctttatcgatgccgatgaaaggcaaatcaacgcggcggcggaagtcggcgcgccgtttatcgaaatccataccggctgctatgccaacgcagaaaccgatgcggaacaggcaaaagagctggcgcgtattgccagcgccgcgaccctggcggcccgtctggggctaaaagtaaatgcgggtcatggcctgacctaccataacgtcaaagctattgccgcactgccggaaatgcacgagctcaatatcggtcatgccattattggtcgggcggtgatgacggggctgaaagaggcggtggctgaaatgaaacgtttgatgctggaagcgcgcggctaatggcgattctcggcctgggaacggatattgtagagattgcccgcattgaggcagtgatctcccgttccggcgaacgtctggcaaggcgtgtgctcagtgacaacgagtgggctatctgggagacgcatcagcagccggtgcgttttctcgccaagcgttttgcggtcaaagaggcggcagcgaaagcttttggcaccggcatccgcaacggtctggcgtttaatcagttcgaagtgtttaacgatgagctgggaaaaccacgtttgcggctgtggggcgaggcgttaacgctggcggaaaaactcggtgtggcgcacatgcatgtcacgttggccgatgaacgccattacgcctgcgctacggtcattctggaaagttagatttgccggatggcggcgtaaacacgttatctgacctacaggccgatatattgccggcctgataagcacagcgccatcaggcattgttgcgttggaagtgcgttaacccgcttacaatttatctgcgtgatgcatcagaacaaacttatcccacaactgttcttcggtttcgacatgggcgggatcctgcaaaatcgtattggggatcgggcagactttctgacaggtcggcgtttcgtaatggcctacacactcggtgcatttgtcgctgttaatctcataaatgctgtcgcccattgaaatcgcctcattcgggcactccggctcgcacatatcgcaattgatacattttttggtgattaacagcgccatcaggaaattctcagaaacaacacaaatcgggcgggcattatacgcctattttctactcgggccagctcttttctggcgctgatttgttatctacagtgtaaaaatttttgatctgcttgagcaggcagatggttgcgttatccagtgaaaggtcattactgtgcaccagcatgacaggaataaagaatgcggggatgcccagtgaaaccaggcgaacatttttgggtgtcgataaatgggttagcgagcgggtaataaatgcgatgccaatctgcgcttcggcatactcaaggcatgagtagtggttatccagttcgcagatgacgttaggaacgactttgcggttattaaattctgtggtgatgatccctcttaatagcagagagtcattaagcacgataatgggctggtcgtttaaatcttttagatgcagacgttcgcgtgtcgccagaggatgagaaagtgggattgcagcgataatttcatcttcaaacagcatggtcgagcttagctgggcagggagcgctgttcgataaacaatgccaatatcaacggcgctatccgtcagctttttaatggtttgctcagttgagaactctttaacatttaaagatatttccggatggtgcgccataaagttgcgaaaagcgggcaggaccaggtagctgcctgacaccccgattgaaatagtatcgcgctgttgatcctgatagggaagaagttcattttcggcattttttaaatccagcattattttgttagcgtgtcgttgcaaaataatgcctgcttttgttaatttaattcctctgccttttcgcttaaataatattgttttaagtgatgactcaagttgtttgatttgctgacttaatgatggctgagtgataaataggcgactggctgcccgaccataatgtaattcatcacacaatatcaggaaggagtgtagttgtttgatattcattaaaatttaatgccaatcgattgggttttgttataacgattataaaaaataccaaattgtttgcctattttgctttttttaaactgtgatcagtgcattttaaaaagggaaaattatgtcggcatcaatcaaccgctggggaatgcttgccgctcacgtgtgcatcaattttgtgctcgggggcgtctacgcatttagctatttcaaaacaccactcatggcgcaatatcactgggatccggctacgccggcgttagcattctctatcaatatggggatcattcctttaccgatgatttggggcgggagaatgatcgacaatggtaaaggaaagcaggcgatagttatcggcggtatcctgttttctttaggttttatcttgtccgggtttgtggataatttgcccatgctgtttttaacctacggcgtcattgccgggttgggatcgggcctggcttttacgggtaatcttaataatattctgaaatttttccctgaccgtcgcggtcttgccagcggtatcgtactggcgggtgttggcgtcgggacgctactttgcacccgcctggccgaatattttatggcgcaaactcacgatgttagtcgggcgttgttatatctgggtattgtttatctggtggttatttttatcgtccagttctttattcgtagcgcgccagcaaaagatagcggaggaattaaagcctcgccactggataaagactatcggcacatgctgaaagatctgcgcttctggctgctgtttatgattctggcgctgggcgtgttctctgggatggtaattagctcaagttctgcgcaaattggtatgacgcagtacggtttactgtccggtgcattagtcgttagcctggtctcgatatttaactcgatcggtcgcctgttctggggagggttaaccgataaattaggcggctataatacgctggttattgtttatctttttacctgcgtctgtatgctgctgctgttgttcttcaacggtaatacttcggtattctatttcagcgctctgggcgtgggctttgcttatgccggtatattagttatcttccttggcttgaccagccagaattttggtatgcgtaaccagggactaaactacggctttatgtattttggttttgccgtcggtgcggttattgctccttacgtcacgtccgctattgcaaaatataccggaagctacaatacagtatttattttgacaacggtgctattgcttattggagtcgtgttgaccctgataacgaaaaaatatgtcgcaacggttttagccaaaattcattaatcagataataaggaaataaaaatgaaaattgcaatcgcaggtgcaggcgctatgggatgtcgttttggctatatgctgctggaggccgggcacgacgtgacgcttattgatggctggcaggagcatgtcgacgctattcgtagcaaggggttgtttgtcgaaacggaaacgactcagaagtattaccccatccctgctatgttggctgatgaatcccagggggagtttgagctggttattctgtttaccaaagccatgcagttggatagcatgttacagcgtattaagccgctgctgccagccgcgaaggtcgtgatgattttatctaacggcctgggaaatatcgaaaccctggagaaatatgtcgatcggcagaaaatctatgcgggtgtgacgttatggtccagcgaactggagggggctgggcatattatggccaccggtaccggaacgattgaactgcagccgatagccagccaagattcggctcaagaggctaaggtcattgccacccttaatagtgctggattgaatgctgaaataagccctgacgtattattatcgatctggaagaaagcagcctttaatagcgtaatgaacacctattgcgcgttactggattgtaatgtcggcggatttggtcagcggcctggtgctttagatttagcgcaagcggtagttgatgagtttgtgttagttgctgccagccagaatattccgttgactgagcaaatggtgatgaatacggtgaagaaagtgttcgatccgcgtgagagcggccaccactatccttctatgcatcaggatttacataaaggccgactgaccgaaatcgactatttaaatggtgcgattgcgcgaatcggcgctcagaacaatattgccgtaccggttaacacactcctgacgcaattgattcacgctaaagaagcgcaataaacttgatagctcttctgcatgaggcggaagagccattttcaaaccagtttttttaccagcgcctcgctatggcgaatacgctccggcgcccgctctaaatcctgttgtaccagcgccataaacagtaagtcggtcaacatcatttgcgcatgtgtcgaggagatagcggcgctacgcgtcgcctgctcttcggcaatcgtatacagacagcgggtggcgcgctgctgcaaggcgttgggagaaaaaccggtaatggccaggattttcgcgcctgcgcgtaatgtttcgtccgccgccaggttcagctcgcgccgctccccggaataagagatcgccagcagcagatcctccggcgccagcgcctgcaccgtcgccagcagggcgtgcatatcgcgctcaaccaccgcgttaatgccaatcttcagtagcttccaggcaaaattttgcgccaccagcccagaggcgccaattccggtgatcacaatacggcgggcgtggcgcagcatcgtgacgctttctaacagcttttcttcactgttaacgtccagcgtggcgtgcatcgccgccacattctctttaattaatttttccccgaccaggcgcatcggatcgtcgccgcgaatctggttatgaacgggaacggaatgcggattaggattgctggccaacgcttcgctgatagccagtttcaacgccggaaaccctttaaaccccagtttttgcgcgaacttgactacgctggattggctgacgcccgcttcggccgccagttgctgcgagctcagatgtcgcgccgtatccggttgcgcgagcagataatccgccagtttcctgtcgctttgcgcgagatccggataacgctggcgaatacgaatcaaacagttcatgggcagctcctgcgaaacgtgatggcgacgacaaaacgaaatttcactcgcctgggggaatattctattccatcatggacgcttattatgaattaaaaattccagagggacaaaaatgaatcttggtaccttagtgtctgaaacccgtaacccgcaaacgatggatctggatgcgttgtctactcctgaattagttaagcgttttaatgaacaggatacgctggtagcggaagcagtaaaagccactctgcctgacgttgcgcgtgcggtggatgctgctgcggcggcgctgaagtctggcggacgtatcatctatatgggggcgggcaccagtggtcggcttggcgtactggatgcctcagaatgccccccgacgtttggcgttccgcacggtctggtcgtcgggctgattgccggcgggccgggcgcgttgctgaaggcggtcgaaggcgcggaagacagccaacaggcaggcgaagacgatcttgtcgcgctaaatctgcaagaacaggatctggtcgtggggctcgcggcgtcgggtcgtacaccctatgtgattggtggcctgcgctatgcgcgacagtccggttgtaccactgttgccgtctcctgtaatccagattcgcctattgcgcgggaggctaatatcgctatttcgcccgttgtcgggccggaagcgcttaccggctccacgcggctgaaatccggcaccgcgcagaaaatggtgctcaatatgatttctaccggcgcgatggtgaagttcggtaaggtctatcagaacctgatggtggatatgaaagccaccaacgtcaaactggtcgatcgcgcgtgtcggatggtcgttgaagcgaccgggataggtcgtgaagaggcggaaacgttgctgaaacagaccgattttgaggttaagcccgccattttgatggcgcttacggggctggatgctgcagccgccagggaaaaactcgccgctcatcagggctttttaagggcggcgttagaacactaaagaggtgtgtatggataagacggcagcgctcgccagcgacattttacgtggtatcggcggagagcaaaatattctgcgcctggaaaactgtatgacgcgagtcagagtggaggtacaggacgacagccaactggatattccgcgcttaaaagcgttgcctggcgtcagtggatacgtaaagcaaggggagcaacatcagctgatcgttgggccggggaaggctgcacaggtggttgatgcgatgcgcgtgcagattgccgcaggtggtgtaaagccggacgatgctatggcgcgtaccaaatccgaggcgaaagcgaagtataaagcgccgatgagcgatgcgttgcgtaagctggcgaatgtttttattccgcttattcccgcctttatcgcatccggcttgattaccggcattatcaatattcttaaacgcccggatatcgtcggcgatgttgccgtccactatcctaacctgctgggcctgatggggatatttggtagcgcggtgttcgctatcatgaacattctggttggcgtcaataccgcgaaagtctttggcggatcgcaggcgttaggcggcgtgatggcggggatcctttccagcccgcaactggcgcagattacgctctttggcgaggcgcttcagccgggacggggcggcgttatcgccgtcctgctggtggtggcgttaatgtgctggattgagcgccagttccgtaagctgctgccggggtcgctggagttaattcttaaccctttattgacgactgttatcaccggcgcggtagcgattgtcgctctgcaaccgcttggcggctggatttcagacgctatcgctcacggcgcgtcctgggctatcgatcgcggcggttttctggtgggcgcggtgttagccggaaccttcctgccgttggtactgatcgggctgcatcaggggctggtgcctattcatgtggagctggtgcaagcgcacggctataacgcgctgtttcccatcctggcgatggcgggggttggtcagataggcgcggccattgccgtactgatgaaaacccgcaatgcgcggctcaaaaaggtgattaaaggcgcgcttccggtcggactgctggggattggcgagccgctgatttttggcgtcacgctgccattgggtaagccatttattggcgcttgcctcggcggcgcggtaggcggggcgttgatcagctactggaaagtggcgacggtaattacctttggtatttccggtttgccgctggcattaacaattgttgccggaaaagtcctgttctatctgttaggctatttaatagcggtaattgccgggtttatttttacctggctgctggggttcaatgatccagaggagtaaggtttggtcagccacgagcgtcgtgtcgtcttttttgatttggatggaacgttatatcaacaggatatgttcggcagttttctgcgttatttgctgcgccgtcagccgctaaatgcgctgctcgtactgccgttgttgcccattatcggtatcggtttactggtaaaagggcgtgcggcccgctggccgatgagtctgttattgtggggctgtacttttggccatagcgaaacgcgtttgcaggcgcatcaggcggattttgtccgttggtttcgcgctaacgtcacggcgtttccggtcgtacaggagcgtctgaccacctatctattgagctctgacgcggatatctggcttattaccggttctccgcaatcattggtagagcaagtctattttgatacgccgtggttgccgcgtgttaacctcatcgccagccagatggcgcgacggtatggcggctgggtattaaccgtgcgctgtctgggccatgaaaaagtcgcgcaactggaacgtaaaatcggtacgccgttgcgtctttatagcggctacagcgacagcaaacaggataacccgctgctttatttttgccagcatcgctggcgggtgacgccgcacggcgagttgcagcagctcgaatagtgaaacgcatagcgtctgtgtataatgccgcccgctttcattaccggagttacctctttgtctgatgtcgaattagatcacgaatactggatgcgccacgcgctgacgctggcgaaacgcgcctgggacgaacgcgaggttccggttggcgcggtattggtgcataaccatcgcgtcattggcgaaggctggaatcgacccattggccgccacgatcctactgcgcatgctgaaataatggcgctgcgtcagggcggtctggtattgcagaattatcggttactggataccacgctgtatgtcacgctggaaccctgtgtgatgtgcgcaggcgctatggtgcatagccgcattggacgcgttgtctttggcgcgcgcgatgcaaaaactggcgcggccggatcgctaattgacgtgctgcaccatccgggaatgaatcaccgggtcgagattattgaaggggtgttgcgcgatgaatgtgcgacgctgctcagtgattttttccgtatgcgtcgtcaggaaattaaagctctgaagaaagccgaccgtgcggaaggcgcggggccggcagtatagcgcaatgccggataagacgttgcgcgtcgccatccgataagaccatcgcgctatttttcttctttcttctgcggcgtaaacagtaaagacggcgaatgcgtcaggtagcctgatgactgcgataaaaacgacaggaaggggaagggggctttattcagctcctccggctacaccgccgggtaatcctgcgccagtttcatagcttccgcttcctgcttttctttttcctgcaaataccccaccaaacttatctggtatttacggatattttccacataagcataagcctcatgtccacgcgcgtaaccgtaggttagcttactgtaatacggtttttggcttaacagaggcaaacgctgcttcacatcggtccagctatccggattgcctttggtttttaccgtcagcgatctggcatcgagcatgtgcgcataacccatattgtaggcggctaaggcaaaccagatacgctcgtcttccggaacggtttcgggaactttagccatcatatcttcaagatagcgagcaccgccgctgatgctttgctccgcatcggtacggtcggtcagccccagactttgggcggtatttttagtcagcatcatcaggccgcgcacgccggttggcgaggtcgccagcgggtcccagtgtgattcctgataagaaatcgccgccagcaggcgccagtctatctctttggcatattttttaaataacggttccagctccggcaggacgttatccaccgctcgcaggaaagagcgggtatcaacgtagtcgaaatcatcgccatgccccagatatttctcttcgatccgcgccaacgacccgtcttcattgatcgaattgaaaaaatcgagcagcgcggcggagagcgtattatcgtcgtccagtcggctaaaccaggtcacgggctgttcatccgtgacatccagcgccacggccagttcgggatggacgcgctgaaacagactgatcgccactgaatcggcaatggtgtaatccagtttgccgctgatgacctcttccagcagcgtcgtcgagccttttttatcatccaccttccagctcaggtcgggaaactttgtctcttttaaacgctgtaaatcattgaccacgacgtgccctggcgcaatggtaagctgattctcgttaacggtcgccagcgaacgtgggcgatattgtccgacccggtaaacgagctgttgcgaaaccgaataatacatggggccgggctgatagtttttaacgcgcgcgctgtcgtagaccagccctgccgcgagcaggtcggcattgccgttatccagatcgtcaaacaactggctgatattctggcgcaccgtcactttcagcttcacgccgagatagttggcgaactgctgcgccagttcatagtccagaccatattttttaccgttgataacggaataggttaatggcgagtcgatcgtactgacgcgcagtaccccccgggcttgaatcgcggcgatatggttttcggttttaccgaaccaggggattgagggccaaagggctgctgccagcagcagcgtcaatatgccgatgaacagataattaatctttaattttttcaattagttaattctctggatcgtgcgttgcctcgggctgaaaaagatgttttgctgcaatagataagtcactaatgagcggcattttgcgtaacaatgcgccagttggcaacttattcgcaacgatagccgcaccgtatgacaagaaaaagcggtgattttatttctacgcaaacggtttcgtcggcgcgtcagattctttataatggcggccgtttccccccttgcgcacaccgaagcttagaagacgagagacttatgatggaaattctgcgtggttcgcctgcactgtctgcattccgtatcaataaactgctggcgcgctttcaggctgccaacctccaggtccacaatatatacgctgagtatgtccattttgctgacctgaacgccccgttaaatgatagcgagcaggcgcagcttacccgtctgctgcaatacggcccggcgcttagcagccatacgctggcgggtaaactcctgttggtcacaccgcgtcctggtaccatctccccctggtcttcaaaagcaacggatatcgcccacaactgcggcctgcaacagattgaccgtctggagcgcggcgtagcgtactatatcgaggcttcgacgttgacggcggaacagtggcgacaagtggccgcagagctgcacgaccgtatgatggagacggtgttctcttctttaaccgatgcggaaaaactgtttatccaccatcagcctgcgccggtttccagtgtcgatctgctgggagaaggccgtcaggcgttaattgacgctaacctgcgtctcggtctggcgctggcggaagatgaaatcgactatttgcaggaggcgtttaccaaactgggatgcaacccgaacgatatcgaactgtacatgttcgcccaggcgaactccgagcactgccgccacaagatttttaacgccgactggattatcgacggtaaaccgcagccgaagtcgctgtttaaaatgattaaaaacaccttcgaaaccacgccggactatgtgctctctgcctataaagacaatgccgcggtgatggaaggatctgcggtggggcgctacttcgccgaccacaataccggccgttacgattttcatcaggagcccgcgcacattctgatgaaggtcgaaacgcataaccacccaaccgccatctctccgtggccgggggcggcgaccggttccggcggcgaaattcgtgatgaaggcgccaccgggcgtggcgcgaaaccaaaagccgggctggtaggcttctccgtttccaacctgcgtattccgggctttgaacagccgtgggaagaggattttggcaagccggaacgtattgtcaccgcgctggatatcatgaccgaaggtccgctgggcggcgcggcgtttaacaacgaatttggtcgcccggcgctgaccggttacttccgtacttatgaagagaaagtgaacagccacaatggcgaagagctgcgtggctatcacaagccgatcatgctggcgggcgggatcggtaatatccgcgccgatcacgtgcagaaaggcgagatcgtcgtaggcgcgaagctgatcgtccttggcggcccggcgatgaatatcggcctcggcggcggcgcggcatcgtcaatggcttccggccagtctgatgcggatctcgattttgcctctgttcagcgcgacaacccggaaatggaacgccgctgccaggaagtgatcgaccgctgctggcagttgggcgacgctaacccaatcctgtttatccatgatgtgggcgcgggcggtctctccaacgccatgccggagctggtaagcgacggcgggcgcggcgggaaattcgaactgcgcgacattcttagcgacgagccgggcatgagcccgctggaaatctggtgtaacgaatcccaggagcgctatgtgctggcggtcgcggctgaccagttaccgctgttcgatgaactgtgtaagcgcgaacgcgcgccgtatgcggtcattggcgacgctaccgaagaacagcatctctcgttgcatgataaccatttcgacaatcagccgatcgatctaccgctggatgtcctgctgggcaaaacaccgaaaatgacccgcgatgtgcaaacattgaaggcgaaaggcgatgcgctgaaccgcgcggatatcacgattgccgacgcggtaaatcgtgttctgcatctgccgaccgtggcggaaaaaaccttccttgtcactattggcgaccgtaccgtcaccggtatggtggcgcgtgaccagatggttggcccgtggcaggtcccggtagctgactgcgcggtcactaccgctagcctcgacagctactacggcgaagcgatgtcgattggcgagcgcgcgccggtggcgctgctggactttgccgcctccgcccgtctggccgtcggtgaagcgttgactaacattgccgcgacgcagattggcgatatcaagcgcattaagctttccgctaactggatggcggcagccggtcatcctggcgaagatgccggtttgtatgacgcggttaaagcggtgggagaggaactctgtccgcagcttggcctgacgattccggtgggtaaagattcgatgtcgatgaaaacccgctggcaggaaggcaacgaacagcgcgaaatgacctcgccgctgtcgctggtgatttccgcgtttgcccgcgtggaagacgtgcgtcacacccttacgccgcagctgtcaacggaagataacgccttgctgctgatcgatcttggcaagggccacaacgcgctgggcgcaacggcgttggcgcaggtctatcgtcagcttggcgacaaacccgcggacgtgcgtgacgttgcgcaactgaaaggcttctatgacgccatgcaggtgctggttgctgcgcgtaaattactggcatggcacgaccgttccgacggcggtctgctggtgacgctggccgagatggcctttgccggccactgcggcgtgcaggtcgatatcgccgcgctgggcgatgaccatctggccgcactgttcaacgaggagctgggcggcgtgattcaggtacgcgctgaagacagagacgcggtcgaaacgctgttggcgcagtacggtcttgctgactgcgtccactaccttggtcaggccctggctggcgatcgctttgtgattaccgctaatgatcggacggtattcagcgaaagccgtactacgctgcgtgtctggtgggcggaaaccacctggcagatgcagcgtctgcgcgacaatccgcaatgtgctgaccaggaacacgaggcgaaagcgaatgatgccgatccgggcctcaacgtgaagctgtcgtttgatattaatgaagatatcgccgcgccgtacattgcgacaggcgcacgaccgaaagtcgctgtactgcgcgagcagggggtgaactctcacgtggagatggcggcggcgttccatcgtgcgggctttgacgcgattgacgtccatatgagcgacctgctgggcggtcgtatcggtctgggcaacttccatgcgctggtggcttgcggcggcttttcctacggcgacgtgctgggggcgggcgaaggctgggcgaaatccattctgtttaaccatcgggtgcgcgacgaattcgaaaccttcttccatcgtccgcagacgctggcgctgggcgtgtgcaacggttgccagatgatgtcgaatctgcgcgagctgatcccgggcagcgaactgtggccgcgttttgtacgtaaccattctgaccgcttcgaagcccgcttcagcctggtggaagtgacgcaaagcccatcgctgctgctgcaaggaatggtaggctcacagatgccgattgcggtttcccatggggaagggcgcgttgaggtgcgtgacgatgcgcatcttgccgcgcttgagagcaaaggcctggtcgctctgcgctacgttgataactttggtaaggtgaccgaaacctatccggctaacccgaacggttcgccgaacggcatcacggcggtgacgaccgaaaacggtcgggtgacgattatgatgccgcatccggaacgcgtattccgcaccgtcgccaactcctggcacccggaaaactggggcgaggatagcccgtggatgcgtatcttccgtaatgcgcgtaagcagcttggttaattagcccgatagccattaagcccctcttcacgaggggcttttttgtagacggcgcttatcaggcccacggggaagcgcggttgtagctaccgtcttgaacgtcaagcggtagggcggataaggcgtttacgccgccatccggcaataaactagcgcttatgccgcaagattaaagtgtcgggaaatcccgacatgagtggggataggttgtcgccaaaaagagacatttaactatttgattttaaatgattttatttttaggtgttgcaggtgttgctgattgacgacagaaaggacaaaaaacagacagagccatttttagcatgaataacgatatttttcatatctatcattgtgttaacaaagtcttttgaatgttggcacaattactgcataatggtaaccagtggctcattcaccttcttatgtcagccccttagggacgcgctacataaacttcgaatgacgcacaacaaggtgcctgccgtctaacttctgataatagcgtagctttatcaacctccgggcgaaacgtcgagttaggcaccgccttattccataacaaagccgggtttagcccggctttgttgtatctgacgctcccctcggttagcatcttttttattcttctttttatgtgagcgacacgttgaagcgctggtctgttttcccccgttctttacgacaattggtcatgctggcctttttgctgatcctgctgccgttgctggttctggcctggcaggcgtggcaaagccttaacgcgttaagcgatcaggctgcggtgactaaccgcagcacgcttattgacgcccggcgcagcgaggcgatgaccaacgtcgcgctggagatggagcgaagctaccgacagtattgcgtgcttgacgatccgacgctggcaaaagtgtatcaaagccagcgtaagcgctatagcgatatgctggatgcccatgccggcgtcttgccggatgataagttgtatcaggcgttacgccaggatttaaacgcgctggcgcaattgcagtgtaaagatagcggcccggaagcggcagcggccgcgcgtctggaggcctttgccaacgcgaatacggaaatggtgcaggcgacgcgtactgtggtttactcgcgcgggcagcagttacaacaagaaatcgccgagcgcggacaatttttcggctggcaggcgctggtgctatttctggtgagcctggcgatggtgctactttttacccgcatgattatcgggccggtgaaaggaattgaacggatgattaatcgcctgggcgaaggccgttctttggggaataccgtcacctttaccggtccgcgtgaattacgatcggtggggcagcgcattatctggctgagtgagcgtctggcgtggctggaatcccaacgccatcagtttctacgtcacttgtcccatgagctgaaaactccgctggccagtatgcgcgaggggacagagctgctggccgatcaggtggttgggccgctgacgccggagcaaaaagaggtggtcgatattctggatgacagcagtcgtaatttacaaaaattgattgagcaattgcttgattacaaccggaaactggtagacagtgccacagagctggaagcggtcgatatcgcgccgcttgtggatatggtggtttccgcccacagtttgcctgcccgcgctaaaatgatgcataccgatgtcgacctggaggccgaacgctgcatagcagagcccatgttgctgatgagcgtgctggataatctctattccaacgctgtgcactatggcgctgaatccggtaacatttgtatccgtagtcgctctcagggctccacggtttatatcgatgtggttaatagcggcgaaccgattccgcaaaccgaaagagaaatgatttttgagccttttttccagggaagccaccagcgaaaaggggcggtaaaaggcagtgggttagggctgagtatcgccagagattgtattcgtcgaatgcagggagagatccagctggtggatgacaaagcgcaggaagtttgttttcgcatctcgctgccattgcctgcatctgacaaacactaatatgaatttaagcctggtgcgtatgtcacacgttttcgtccaaactattaaacgatgccttttgcgatggggaataccggtgggcatatcgtgtctggcgctgaccgcatgtgttccccatgcttcacagcaactgcccggtagcgcagcgcaggacacgctcccccattatcaactggcggattatctcccgacggcgtgcgcggatatctggtcgctacgcgggcaggcggtggagacgaatccgctgtactggctacgcacgattgactgcgccgatcgtctgatgccggttcagtcgcgcgcagaggcgcgcgcgttgacggatgataactggcagaatgccttcaggcgcgggattttactggcggatgcaaaaattacgccgccggagcggcgcgccatagtgacccgtctggaggcgttaagcgcgcaaataccggctcaggtacggcccgtctaccaaatctggcatgacggtcaggcgctgcaattagcgctttctgccgaacgtcagcgttatagcaaactccagcaaacgtcagatagtgagctggatgcgttgcgccagcagcaacaggccttgcaaacgcagctcgatcttactacccgtaagctggagagtttaaccgacattgagcgccagctttcgacacgaaaaccggcagggaattacaacgccgatacgccgcatacgaatgacaaacccgcgacgtctgaagatggcgcggcgccgtcgccgtcacaagatgaggtaacgccatgataagccgtaaaccggcgcacctgctgctggtcgatgacgatcccggattactgaaattgctcggtatgcgcctgaccagtgaaggatacagcgtcgtgaccgcagagagcggccaggaaggactacgggtactgcatcgggaaaaagtggatctggtaataagcgacctgcgcatggacgaaatggatggtatgcaactgttcacagaaattcagaaagtacagccgggaatgccggttattattctgacggcgcatggttctattccggatgcggtggccgctacccagaagggcgtattcagctttttgacgaagccgatcgacagagacgcgttatataaagcgatagatgaagcgctggagcagtccgctcccgcgacggacgatagctggcgcaacgctatcgttacccgtagcccgctgatgctgcgactgcttgaacaggcgcgcatggtcgcgcagtcggatgtcagcgtattgattaacggacaaagcggcaccgggaaagagattttcgcacaggcgattcataatgccagcccgcgcaataacaagccgtttgtcgccatcaactgcggcgcgttaccggaacagttgctggagtccgaattattcggccatgcgcgcggcgcctttaccggcgcagtgagcaatcgtgaagggttgttccaggcggcggaaggcggcacgctgtttctggatgaaattggcgatatgcccgcgccgttacaggtgaagctgctgcgggtgttacaggagcgcaaagtcaggccgctgggcagcaatcgcgatattgatatcgacgtgcgaattatttccgcgacgcaccgcgatctgccgaaggcgatggcgcggggcgaatttcgtgaagatttgtactaccggctgaatgtcgtgagcctgaaaattccggcgctggcggagcgtaccgaggatattccgctgctggctaatcatctgctcagacagtcggcacagcggcataaaccgtttgttcgcgccttttctactgatgcaatgaaacggctgatgacggcaagctggccgggcaacgtgcgccaactggtcaacgtcattgaacaatgtgtggcgttaacctcttcgccggtgatcagcgatgcattggtcgagcaggcgctggaaggcgaaaacaccgcgctgccaacttttgccgaagcgcgaaaccaatttgaactgaactatctgcgcaagttactgcaaattaccaaaggtaacgtgacgcacgcggcaaggatggcggggcgcaaccgcacggaattctataagctactctcccgtcacgaactggatgcgaatgatttcaaagagtagttttcatgccgtaaagtagcgcgaaatatgttacgtttaaccgatcaaaacacaggcgaccttttcaaggaatagcatgaaaaagattgatgcgattattaaacccttcaagctggacgatgtccgtgaagcgctggccgaggtaggtattaccggtatgacggtcactgaagtcaaaggctttggccgtcaaaaaggccacaccgagctgtatcgcggcgcggaatatatggtggattttctgccgaaggtaaaaattgaaatcgttgtgcctgacgacatcgtggatacctgtgttgataccatcattcgtaccgcgcagacggggaaaatcggcgacggtaagatctttgtctttgatgtcgcccgcgttattcgtatccgtactggcgaagaagacgacgcggctatctgatgtgccgattcgctgcccgtctcctccttgtgggcagcgaaccaccgtttaatcgccctgcggtagcgccgatgtagtccgggtgcaaatccatctcaggccgacaatggcgacgatcagcgccacgcaacttagtgtccactcgctcatttgcgagaaaaagtgtccgtaggcggctaccgccgtatcactaatttgcgattccgtggtttgttgcgcgacgacgccagccagccagttagcgatcgcgccggtcgccagcatataaataccggtcagtacgcccgtgacgccaggcagattgaggcgggtaatttgcgccatcgcgaccggatcaataaacagctccgcaaagcccatcagcgccagccctgcgatcatcattcccattgatgcctgcccatctaaccgggcctgatgcgcgtttagcgccagcagcataaaaccgccgcccattaatatcagccccacggcaaatttaagccagacgcgcagcaccgagcgggcgctctctttcgggctgctcagccacgccagcaccacgcccgccgccatcaccgcaatcgcattgaccgactggaacaatgcggtggggacggtcatattcagccagtggcggttgacaaaacggtcgatgaataaactgatcgaacttccgccctgctgcgccagaacccaaaagagagtgccggtgatcattaacagaacgatttgccacaaggcgcgacggtgttcgggaaatttaaccataatacgggcgataagttgcgccgcgaagacgcagacaatggccagcacatagccagaccagttattttccagcaggagggtgaagaataccggcgcgatacacagcattaataccagccaaccccaggttggaagggcgaatttaaccgcccgcagcgcggggcgattaacaccgcgcgtctgctgaaagtggcgatgaccgcttaaaaagatgagcaggccgatgaacattccgacgcccgccagcgcaaagccgacatgccagccataccactgcgccgccagaccacaggcgatcggcgcggctatcgatccaatattcccggcggcgtagagcagcgagaatcccccgtcgcggcggttgtcatcaggggcgtaaagttcgcccagcagacagctaatattggatttaaacaagccgtagccgcagataataatggccagcgccgcatataaactcagcgttgaatcagattctaagcccaataccacatgacccagcgtcatcaataaggcgccggtgataaccgccacgcggttgccaagcaggcggtcggcaagccagccgccaagaataggggtaacgtaaactaaagaggcgtaggcgctgaagaggttgatcgcgtggctgtcattaaaaccaagctggtgggtaagataaaggatgagtaaggcacgcatgccgtaaaagctgaagtattcccaaatttgaatcgccacgatgtaaaaaatcgcgcgcggttgtgagggtgttttcataaagtctccttgctgcgtgaaaaaagggaagtggcaagccacttccctttggtacttatttcgtattttctttcagcaccttaacggtgtaacgtccgtcagcctgacgataggcgccgtggatatcggtttcgaagcccggatagtgagcgccgatttcgcacagcatttgcaggaattccagtaccggacggctttcctcggtgatcatttcaccaggcatcaccagcggcactcccggagggtaaggaaggatcatgttggcgttgacgcgtccaaccatctcttcaagatacacctcttccgtttcgccatgcagctctttctggaacgcagtatacggcgtcatcaccattttcggcagcacttcaaacgcacggtacattaagtccggcagattatgatgttcgaccagtttatgaatattctgcgccagttcctggatgcgcatattttcataaaactcaggcgcttcgcgatacagtgccggcagaatgtttttgacgcgcaggttcaggtcaaaggcgcgtttaaattcagtgagcgcgcgcagcaggctcagagctttggttttgtcgataccaatgctgaacaggaacagcaggttgtatggaccggttttttctacgatgatgccgcgttcatcgagatatttggcgaccagacttgccggaataccgaattcatccatcgtaccgtctttcttcatccccggcgtcaggatagtgactttgatcgggtcgaggtacatgtgttcgttatcgatatttttgaagccatgccatgcgctatctgaacgcagcggccagcactcagctccatcgatatgttccggctgccatacgtcaaagaaccagccgtcagattcgcttttcaggcgtttaatttctttacggaatttaatcgcacgttcaatagagccgttaatcaggcgtttacccgcattacctttcatcatcgccgctgcggtttcagtagacgctacgataccgtagtgcggagaagtggtggtatgcatcatgtaggcttcgttaaaggtttcttcgttaatgtcgcctttaacatgaatcatggatgcctgtgaaaacgccgccagcagtttatgcgtggactgggtttcataaatgattttgccttctacacggtcgccgctcataccgcatttaccctgataaataggggagaaattggtgtaaggcacccaggcggagtcaaaatgaatggacttcacatccagagttttcttgatgtagtcagtgttatacaacagaccgtcataggttgagttagtaataacagcatggaccggccaggtggcgttaggcgtctcttttacccgtttagcgatagtggcgtgctggaactcgctttgcggaataccgccaagaataccgtaggcgttacgggttgggcggaaataaatcggcgtaatgtcgctcatcatcatcagatgggtcagcgatttatggcagttacggtcaatcagtaccgtgctgcctgccggcgcggagtacataccgacgattttgttcgccgtagaggtgccgttcgtcaccatgtagctacgttcggcgttaaagacgcgggcgatatactcttccgcttctttatgcgggccggagtggtccagcagcgaacccagttcggaaacggaaatcgaaatatcggatttcatcgtgttcgggccgaagaaatcataaaagatgctgccgacggggcttttctggaaagcagtaccgcccatgtggccaggcgtacagaaagtgtatttcccttcgcgcacatatttgaacagtgcttttgtcagcggcggcagaatattgtcgatgtattcatcggtattctggcgaattttcgccgcgatatcggctgcggcgcctaaagcatattcaaagaagcgaacctgcattctcagatcgttgaggctgacgtccagcgtagagtagctgttggcgaaggcatacagcggcatatactcgttcagcttgctaatctcttcgcaaagctcaaggttatatttatcccagtcgaaaatgacgccgcaaaggcgggagttattttcaatcagcttcagcaggtcttctcggtcgtttggatagacgatacggaaatttaaaccttccagtgcacgatgcagttcacgaataggctcttctttaaagtagacgcccatgtggttcatgatagcaataacgttcatagtcttgttcctggtaaagtgggcccctcccgctacgctatagcaggtgacgaaaggggctttgagaaaaaggagttagcggttaaagcgcttcagccgtattgttgtcgctgtcgttgttctggcgctggtgcattttgcgaccgtagaacatcaggatgatcagactgacgataaaggtgccggagagttcgaaggagctggcgcccatcagtgcgatgaagcaaaatgcgcagcccagtacagaacaaatcaggcttaccgagttacggatgttgaacccttcgaaacgaatcaggtcaacacaagagtagaagtacggcagcatggtaagcagtacggcaatcccggtcagttcgccgaacaggtcggacgctttaccgccgctggagttcatgatggtgatcagaatcatcagcgccgtcattttcaccgcagccaacagcagaccttttttcggaataccgtttttatccatttcaccgtaaattttcgggaagttgccgtcgttggcggcgcgaaccccagcctggccgaccagcatcatccaggagcccagagacgtcaggcaggcgaaagcggtaaaggcggaaaccagcggcgcagcccagccacccagaatcgtggaggtactgatagcgaacggcgcgccggaagaggccataacggaagctgggaacatcccggcgataacctgagtcgcggcgatatagatgatgcctgccagcgcggtacccagcatggttgccagcggtacggtgcgtttcgggtttttcaccatgccggtgctgacggcggcagactcaacgccaacgaacgcccacaggcagagcagaatacttttaacaatggcgtgagagtcggtcgtcgtagacgtgttccagttcgcgtgataggtcgcgatagcgaaccaatgccagccggcgactgcggtcaagactaccgggatcagcaccagaaacaggccaatcgttgtcaagcggctgacccaggccccgcccagcatattaataaaggtgaacagccagacgatagcaatacaggcaatacctgccggtattggattatttaatgccgggaagaacgtagaaagataagaaaccgcggtaataccgatggctaagttaccaatccagtttgcgtgataataaagaacgccggtctggaaaccaaacgccggagatatttccccagcataagcgatagggccaccctgttgcgggtttttggttgccagcctcgcataaacataagccagcgacattgccccaataatagaaattacccagccccagatggcaatgccaccaatactggcaaggttggcgggtaataatgcaatcccgctccccatcatattaccggcaacgacgccagtacaggcaaatagcccgatctttttgacagaactcatgttcatttctcctgagctgtatttttaagaaccgggcttatgcttcatatatgctgcgtgcccgttcaactgtcgacaagattaacgaatgggttgagataagtcctaaagaaaaagtgaaataaacacaaacatgaaaaaactgatagattgatttttttgaattaacatataaatatcatgaaaggataaatattgtttaattacaaagggttatatttacatttctttgcgatgaatatgttgccaaaattaacataagctattttttgcaacatatttttcacaaaataaaagcgaaaaatttaatatcttttcgcttttatttgtcatggttcagcgttaaatttaatcttctgccagaaaactattcagataagggacaattttctgaacggatgtctgaaatacgccgttctcgatccagtacagcgtattttcacctggacgtaaattaaaggcggtcagataggcatcagcggccagacgattctcacctttcatttcgtaaactttccccaacaggacatagttaaaccacgacatttcaagctcgatgcttttattgatttcctcatacgctgcatcgatatcacctttgcccaaaagatcaacggtcttgattttataataaacagacgttttctcaacgcccggaatttgatctatttttttaaactcttcgttcagcgcagccacttgttctttatcaaacggctgttgtgattgccgtaatacatctaccagcactttatattcataggcatagttgaaatcaggcgtttccttaataatgccattcagaatatcgccggctttacttagcgcctgcgcatcgccgctcagaataagctggcgcgcctcataaaaacgcatcagcgcggtattttgcggcgttctgaacagggccagttgttctcgcatacgattaggccagggctgtgttaaaacgaaagacaggctattaaacagatcatcctggatggacaactggttagtattggtgacgaaataacgcttatccagcatggttgaaccatcggcgttatcaatgagcaccacagacataaagcactgctgcgcccgatagtggcgctgattgacaaactgaatggttaacgtcttaccggagttgcttggctcattgacccggtaattggttttatcgtgcaccataaaggtcgagtaggtgttcagcaggtcggtgattaagccgcccagaccgatggcgtaggactcctgcgagacccagttattacaggaattgccgccttcaaaacgaacatctatatctcgtgggttaagtaataaccgcgtttttgttaccgcggcattatgatctaccaccgacatcacgataaacaccaccagcgtcgccagcgagagcaggaacatcacccacgtccagaaagcggcgatacgcggctttttcgcctttttagtcggcgtttgcaaagaggcgggcggcacaggcgcagcggcaggaaccccctctgtcggttctgcattcgtcgctgcgatcggcggcggcggcgacgttgataaattatcgatctcatcgctattttcttcgcaccagataaccggcgccgtcagcttatagccgcgtttaggtacggtaacgatgtattcagcattgctgtctccgccatctcttaatgatttgcgtagttcagaaatgctttgggtgacaacatggttggtcacgatggtgcgcatccagacatgatcaataatgttatcccggcttaacacttcatccggatgatgcgcaaaatacatcagaagatcgatcagccgtggttcaagagtaatctggcgtccctgacgactgatctgattaacagaaggtgtaaccagccactctccaatgcgtacaacaggttgctgcataaaaagatgccctaacgagctaagtcaaacgttaataataacacgatttgcacagacttttttattccccttttttgtaaaagaaaggcataaaaagcagcgcaataagcaggagaacggggaggaaaacgggcgttcgccttaacgataacgcccgttttttcagcggatttcttgcaattacagcactttatgcgggccgaagcattcgtaatgaatgttttcgttattcacgccaagtgaaaccagttgttttgcggcaaactgcataaagcctaccgggccgcaaagatagaactgcattgccggatcgctgatcgcggcttccagtttgcttaaatccatcagcccttcgctgtcaaagacgcgttgggcgcgatcggcctcggttggctcgcggtaccaggtatgggcagtgaaacgcggcagtgtacggcccagctcgctcacttcgtcggcaaacgcatggacgtcgccgttctccgccgcgtggaaccagttcacctgcgcggtatgctgttctttcgccagcgtatcgagcatcgccaacatcggcgtctggccgacgccagcggaaatcagcgaaacgggggtatcagcggcgacattcataaagaagtcacctgccggcgcagccagatgcaccacatcgcctacgttggcgtgatggtgtaaccagtttgatacctggccgccgtcttcacgcttcacggcaatacggtaccctttgccatcgggtttacgggtcagtgaatattggcggatctcctgatgcgcaaaaccttccggcttcagccagacgcccagatactgcccgggacggtattccgccaccgtaccgccgtcgaccggttcaaactcaaagctggtgatcagtgcgctacgcggggttttcgcaacgatgcggaaggggcgcgtgccttcccagccgccgtctttgctggcgttctcgtgataaatctcggcttcccgatgaataaagacgttagccagtacgccataggctttaccccatgcgtccagcacttcctggcccgggttgaacatttcatccagcgtcgccagcagatgcgtcccgacgatgttgtactgctccggcttaatctggaagctggtgtgcttctgcgcgattttttctaccgccggcagcaacgccggtaaattttcgatattgctggcgtaggccgcgatagcattaaacagggcttcgcgctgatcaccgttacgctggttgctcatattgaagatttctttgagctccgggttatgcgtaaacatacggtcgtagaagtgggcggtcagtttcggtcctgtttcaaccagcaggggaatggtggcctttactgtagcgatggtttgtgcgtcaagcatacgtgcttcctttatgtgaaaatctaataatgtatatcaaatgcatcttataaaaatacccttgcattgtaaatggatcttctctgctttacgttatggaggtaacaacgtgaaaaatctgcatcacaaagctgaaaagaaatccgttgaaattcgtcaggctctcgttcaggaaacccttatctgacgcataggtaatcgtttgcgtaaaaacctttgtcaagacctgttatcgaagaatgattcggttatactgttggccgaagtcccacggactgccttttcaggcacaaattttattgttagctgagtcaggagatgcggatgttaaagcgtgaaatgaacattgccgattatgatgccgaattgtggcaggctatggagcaggaaaaagtacgtcaggaagagcacatcgaactgatcgcctccgaaaactacaccagcccgcgcgtgatgcaggcgcaggggtctcagctgaccaacaaatacgctgaaggatatccgggcaagcgctactacggcggttgcgaatacgttgatgtcgtagagcagctggctatcgaccgcgcgaaagaactgttcggcgccgactacgctaacgtgcagccgcactccggttctcaggctaacttcgctgtttacaccgcgctgctgcagccgggcgataccgttctgggtatgaacctggcgcagggcggccacctgactcacggctccccggttaacttctccggtaaactgtacaacatcgtaccttacggtatcgatgagtccggtaaaattgactatgacgagatggcgaagctggccaaagagcacaagccgaagatgattatcggtggcttctctgcctactccggtgtggttgactgggcaaaaatgcgtgaaatcgctgacagcatcggcgcatacctgtttgtcgacatggcgcacgtggcgggcctgattgccgcaggcgtttacccgaacccggttccgcacgctcacgttgtcaccaccaccacccacaaaaccctggcgggtccgcgcggcggcctgatcctggcgaaaggcggcgacgaagagctgtacaaaaaactgaactccgccgtcttcccaagcgcgcagggcggcccgctgatgcacgtgatcgcgggtaaagcggtagcgctgaaagaagcgatggagccggagttcaaagtttaccagcagcaggtggcgaaaaacgccaaagcgatggtggaagtgttcctgaaccgcggctacaaagtggtgtctggcggcactgagaaccacctgttcctgctggacctggtggataaaaacctgaccggtaaagaagctgacgccgcgctgggccgtgctaacatcaccgtgaacaaaaacagcgtgccgaacgatccgaagagcccgttcgtgacctccggtatccgtattggttctccggcggttactcgtcgcggcttcaaagaagcggaagtgaaagagctggctggctggatgtgtgacgtgctggacaacatcaatgatgaagccaccattgaacgcgtgaaagcgaaagtgctggatatctgcgcccgcttcccggtttacgcgtaagcgtttgtgttgtgtaaatggcccgatggcgctgcgtctgtcgggcattacttatgcgccataacgtgacgccgccggaagtcattatccggcggcgttgccgtttgaacttctccctccgcctgttacccttgccagcgcaaccgtttaccgccagactatcgcctccaaacgggagggaatcatggcattgcattccacgcgctggctggcgctcagttatttcacctacttctttagttacggtatttttctgcccttctggagcgtctggctcaaaggtcttgggctaacgccggaaaccatcggtcttctgctgggcgtgggtctggtcgcgcgttttctcggtagtctgctcattgcgcctcgcgtaagcgatccttcgcggttgatctccgcgctgcgcgtcctggcattgctgacgctggtatttgcgctggcattttgggcaggaacgcatgtcgcgtggctaatggtggtgatggttgggtttaacctcttcttttcaccactggtgccgctgaccgatgcgctggccaatacctggcaaaagcaaattaccctggactatggtcgggtgcggctgtgggggtccatcgccttcgtgatagggtcggcgctgaccggtaagctggtgagtttatacgattaccaggcgattctggcgctactgacgctcggcgtcgcctcgatgttgctgggtatgttgttacgtcccagcgtgccgccgcaaggggaaagccgtcagcaggagagcgcaggctggcccgcctggcgtacgctggtggcacaaagttggcgttttctcgcctgcgtctgtttgctgcaaggggcgcacgccgcctactacggttttagcgccatctactggcagggggctggctattcagcatcggcggtcggctatttatggtcgttgggcgtggtggcggaagtgatcatttttgccctgagtaaaaagctattccgccggtttagcgcccgcgacttgctgttgctttctgctgtgtgcggcgtggtacgctggggactgatgggctggagtacggcgttgccgtggctgattgtgatacaaatcctgcactgtggcacgtttaccgtttgccatctggccgctatgcgctatatcgctgcgcgtcagggaagcgaggtgattcgtttgcaggccgtctattccgctgtggcgatgggcggcagtatcgcgattatgacggtatttgccggttttctgtatcaacatctgggcggcggcgtattctggattatggcgctggtggcattgcccgctatcttccttcggcccaaagtggttgccgcgtcatgattccaggatcttgcggatctgctgctgttggtgctctgtgagggcgcgatccgcatgaattaatggcggtgagaagagcggtagcggcgtggcgtaaggggtaacaatcagcgctacgccgcgcgggcatccctctttttgaaacgcctggagcgatatccgtctgatattcagcggcaatagggtcagttcacgcagttgctgctcaatatgcgtctccagcgcatcatttttatccgctaacaatacgatctgtctctcatgcaaatcgttatcctgcatcagccaggcgccgaaaatcactgccaccagccccgtctcttcctcggaaaagtggataccatattcggcttcaaacccggcgagcgcctcacgtgtggtgcgaaccagacgcggataaagacggttgaactcttccggaagcgtattatcgatgccaatcgtgaataaacttcggttcagcgcctgggcgagatggacatacagctgatcgttaagcccttgttcgtcgctgaagcgtacgttccctttttctcgaaagcgcagcaccagccgcgccacctccagtcgcagttgctgcgcccgttgatgcgtgtcgcgaatcgggtcggggaggcgaatcattgaaaacagtaacgccataaacagcgcttcattgagcggtgcggcctgcatcacgtggcgctgccagtgacgaccaatttcctgggcgagtggatattccgcacacgactgcgcccaaatctgctgtacaggattgaattccggggtgatgccggcatggtgttgtagcagacaatactgtaaaaagagacgcaggaactgcacgtcgcgatgttcaaatggtttttgcaaccggcgggcgcacagattgatgagcgcgtgcagattaatatcgtcatacagcggacgcgcgataccgcgctgctttagcgcgttttttaaggccggggtaaactgttgcgtgacgaaggtcgggcataaacgcaggccgcgcctgagccagtgtaaaaggcaaaggcgctgatcgagtgctgtaccttcgatccgatagcaaccgttctggcatgttgtgatggcaaggcgatgatagcgctggatctccaggcttgtgtcagtgatatcctcacgggcagtatcatcatcaacgccattaagcgcgctgaagatttccaccgtggcaattggctccggctggaaaagcgtcagcaatacctgacagcggcgctggggagcggaaagtacagatggtggggcaattgtcggcatcatctgtcaggtctcccgttagtttatctggtaaggatagctaaagtttgcatgtgaaaaatgtgataagtgtgcttttaggccaggaatgctgaggagtgtcacagaatttttatcgcgaggaacagatgaagccagtgaaacgcagcgccttaatactatttctcgccgttttatctttcgtggcggcggcgcatccgcacagcttcatccgtctgcaaacgcaggtggtcagtgaaaatgagcaatttgtggcgttaaaaatgcgctggacaatggacgcgctgacgtccgccgatctgctgtatgacgccggaaacgcggcgccgggttcagaaatatggaaaaagttggcggcggaagtgatggctaacgtacttgggcagcactactttacagaagtgtggcgcaatggcgcgaaagtgaagtttaaaaacaggccgacagaatacggtatgacgcgtgacgcgcatcaggcggtattgacctttacgctgccgctggctgaaccgcagccgttaagcggccagacttataccttttcaacgtttgatccctcttattatgtcgatatgcattatgaccaggacagcgatatcacgatgccggaaccgctgcgcgaaaagtgtcggattcaggtttatactcctgcgcccggcgaagagacgctacgtttcgcccagtcgctggataaagaggacgcgccgccggaggatatggatttaggtaaacagtttgcccaaacggtgaccttgcaatgtcagtaattttttctcaacgcactccggggcgacgctggctctcgctgtggccattggcgttattcctgctgctgatgctggttggcggtctgtggatatggcaggcctggccgcaggtgatgctgaaaagcgctctttggcagcgggacgtgaatcagcagttgagcgcgctgcttaatgcggtggcgacgcatcctgagcgggcgggcggatcgttgcttctgctgagttttatgtatggcgtgcttcatgcgtggggccgggacacggcaaagtggtgatcgcgacatggctggcgacgcatccttcgaagctgaaatcaagtatcgtgttaaccctcgccgccgcgttattgcagggggtcgtggctatcgggttggtggtgggcgtgctgaccgtattgcaacttccggccaggcagctccatctgagcggtttctggctggaaaaggggagctatgcgttagttggcgggctgggcatcttgctgtgctggcgggccataaaaaggttacgcgcgctgctacgtaaacctgtctttatcgcttttacgccgcgccatgttcaccatgaaaaatgcggctgcggacatcagcatctaccgacgcaggaacaattgcatagcggcgatgactggcgcgcgcgactcatgatcgtactgtctatggggatgcggccctgttccggagcgataatggtgctgttattcagtaaagtgattggcgtttttagctggggaatggcgtcggtactggcaatggcggcgggaacctcgctaacgattacttcgctggcgctgctggtacacacttttcgtgctctggcggtgaagctcagtggaaacaaagcgccggcgttatggcggcaggtaggctggtcaacgctggcgctggccggaggggtcatactgcttgtcgcggcgctggtcatgtggtttagcgtgccgcagcctgtgggcgggctgcggccatggcgtggttgactagtgcccggcgggtttgagatgcatccgcgcgacggattcgtcttcggcccagtaaatgcgttcggcgaccatcgcttccggattgagctgaacgccgcgcagtacccgttctttaaaacgcagatagccgcctttgtcgatcagatggcccatatgtagatagatcggttttccgccgagcatctctttttcaaattcatacaggttaacgatcacctgctttatcacatcttcagtcacccagttgaggaagagcttgccgacgcgcggcgtctttttactggtgcgtccgcccagacggacttgccagagctgatccggcttacgttgccaggccagcgtcggacaggccagcacgcactcgccgcagccgatacaggcggactcttctttgaccgctttgccgttcttcagcgccaggcagcctaccgcgtggtgactacaggccttcacgcaggcgccgcaaccgatacagcgatcggcagtgaagcgcattttcgccacgccaataattcccagatcggccattgacgccttcgcgcaatcattcgggcagccaacaatgaccgttttgagatgataagggctgggatagaccagtttttcaagacgacgggacagaccggtcgtgtcagtgttggctttctggcaaatgcggttcccctgacaggcgacaatatttcgcccgccaatagcgagatagcccgctttggtatcctcaacctggacgtcgcacagttctatttcaatctcgcgaagaaatggctccagcgcagcgttcacgttgtcgatatcttcgtaacggatacccggcatcgccagcttctggcgggtagtgaggtgaatttgtccgttgccccaggtttcggcgatgtcacgcgccaccgttagcaaatgcgcgggcaaaataccgccgggaatgcggacgctgatcatggcttcgccgcgcacttttgataggcgatattcgtttttcgcacgggctttaatgatatcaatatcaatgctcatgatgttctccttaatcggcaaaacgttgcgcgacggcgtagttaaatatcgggccgtcggtgcagacatacacttcgcccatacggcagtggccgcacttcccgacggagcaggccatccggcgttcgtagtccacccaaatttgctccggcttgagccctttttgcagcagcatttttacggtaaaggtaatcattattggcggcccaacgacgatggcctgcatggtgtcgatatcgctaagcgtcatgtcggcaagccgatcggtcacccgaccaatctggtaacggtcatcagcctcgccttcatccagcgtgagcaccagattatgtttgccgtgccacgtcgccatttcttctttgtacagcacgcaatcgcgatttttatagccgagaatcatatccagttgaccaatttcctggggattctcaacgaaatagcgcattaagcctttcaccggcgcgacgcccgtgccgcctgcgacaaccagtaagggtttatggcgcagagtatcgaccggatagccattgccatagcagccgcgtagccacacgttgtcgccttctttcagcgtaaagagggcgctggtcacttttccgacattacgaatcagcagatctatccagccatcgccgtagtcggaaacggagatgggcgcttcgccgacgcgcggcagcgacacctcaacaaattgcccccagtgcgcgggaaaatcgacggccacgcggaaattccactccagcggcgtgtggcgagtaatactgaggatgcggtacgccgcaggcagcaaactgtgctgcggtttatcatgacaggaacaatgtgacatgcgttatgcctcctctgccagcgcctgccgaacggcagcggtcattttgttaataatcaaagaaaatttgatgtattgcgggcagcgatcgtcgcagcggccgcagccgacgcacatatgttcaatgccgttgcgcgctttgtagtcattgaccttatgcagggcgcggtagcgcagacgctcgccgggtttttcgcgaaaaccatgaccgccggccatgtcgctaaagcccggcaccatgcagcttgcccactggcgacggcgttcgccgcgctgcggattttcatcataggcgacgtcaaagacgctatagcaggtacaggttgggcacccggtagtacagcggccacaactgatgcagcggctgtcgtaggcgtcccatagcggatggcgagtgagaatgtcgcgaattttttgcggatcgcggcaaacgctgtccggcgtgacgacggtttcccggttttcgctgacgaaagagggggtatagtcagcctcctgccccagtccttgtatcgccgcctcgataaagggatcgcggatgctcacaagcgcgccctcatcgctaaaacgcatggcggcgctataacagtcagttttattagtacccattgagacgcagaaacaattttcgaagctttcttcacactcaataaggacgaaacgaatatgctcccgtagcagttgataactgtaatcggaattattcccatttgataaatacatataatccagccgcgacatggcgttaatgtcgcaggcgcgggcaaagatgattatcggggaggtgtctgtctcggcaatttgaatggtgtttttatcgaaataaaagagcgtttcggtgataggggcgataatggtattcggcgacatgtgcgatttctcgtgccagatgagatcgcgccagccgctaatccgttgataaataatgttgtcagtgtcggaaaaacgcccgccgcgaaactctgcggacggggcaaacacgcgccattttttgtttaatcgctggataagcagactaaactcgtcaggcgtaattttgatagccatcacatactccacagtaatattcaggaaaaacaaatgaaaataaattgttataaaaatcagatgaatattactgttacgctagcgctaatccgccgccttcgctaacgggaaaaaatggtttttactatcggtataataaatatattcttaatcataaaatatgcatatatacagcgtcgcgctatttagcggatagcgctgtctgaataaaattaatcatcgcatcgcggtaaaggtttgcataacgtccggaaaaagcatcaatgtgatcgccgtcaggaatgaagattttttgtttgggctcccgggcgagggcatacaatttctcactgtcctgccagggaataacatggtctgccgtgccatgaagaatcaataccggaatggggctgacgctggcgatattgcgatccgcgctatagcggtcatcaagcaaatagccgctgcccgggatcatctggttggcgatggaggaataggatgaaaacgttgagtcgaggacaatcgcacgtatgcccgcctggtcggcgtagcgcatatttgcgcagcctacgcagtggcctacggcggccagtacattattgccgcccaggctctgccccagcagtaccaggcgctcggggttaacgtcggcacgatgccgcacataatctatcgcgcttttcgtatcgttcagtagcccctcttgtgatggggtgccctcagattcgccaaacccacggtaatcaaacataaacaggtttacgttgcgttctggcagccaactgactaacggccagtgcgccgacatatttccggcgttgccatggacatgaatcaccgtcgcgacggcgttttccggcctgccgaaagcagtaggaataaaccagccgtgcagatgcgtgccatctttggcggtaaaggtaatggattcagcttcggcaggggttggtccatagactttattgtccgggtaataaaaggcattgatcgctacgcggggtagcaggtaaatacagactacaatgataaacagaataaaaagggatttgacgatgcgtcgggtatgttgaagggtcatgttcgcttccttgccgctttatgtccatagcggagcagggagcgatcgtacaaaaacatgcaggcaagtaaagcgatgaggtggtgtttaggaaaaacgcctgaaaaggcacggcggatgagtggccccatccgccgaagagacttagcgcttcagcgcatcgctcagttcgtcgcgcatattcgccagcatggctttaacgacgcgcggattccccgccacgatattaccggtcatcatgtagttatgaccgccggtgaaatcgctgacgataccgcccgcttcacgaaccagcagttcgcccgcggcgaaatcccacggacgaaggccaatttcaaagaaaccatcgacacgacctgcagccacataggccagatccagcgcggcggaaccggtgcggcggaaatcggcgcattcggtgaacagcttgccgataatattaatgtaggtggtcgcgtattgtttggctttgaacgggaagccggtagcgaggatagtgccgtccagatcgcgcgcggtactgccgcgcagacggtagccgttcagctgcgcgccctgaccgcgggtggcggtgaacagttcgttacgcatcggatcgtaaacgacagccacttcagtacggcctttaatgtgtacagcaatggaaacagagaagtgtggcagacgtttgatgaagttggtggtgccatccagcggatcgataacccattgaacatcctgatctgtgccaacgtgctcaccgctttcttcggtgataatagtgtgttgcgggtaagatttgcgaatggtgtcgataattaccgcttcagcggccttatctacgttggtcacaaaatcgttactgcctttttggctcgcttctgcagcgtccggagtttcatagtttttggcaattacattacccgccttgcgcgctgcgcgcacggcgatggtcagcatcggatgcatcggtctctctcactggatgttaaagaacgggaaaacggcgcagagtatagcagcgagatcggaatctgtcttggttttatggtaagatgtccgaataatctttagctgaagaaagacaatgctgcaaaacattcgaattgtgctggtggaaacctcccacaccggcaatatgggctctgtggctcgcgctatgaaaaccatgggcttaactaacctgtggctggtaaacccgctggtgaaaccggactcccaggccatcgccctggcggcaggcgccagcgatgtgatcggtaatgcgcagatcgtcgatacgctggacgaagcgttggctggctgtagcctggtggtcggcaccagcgcccgctcccgcactctgccgtggccgatgcttgatccgcgcgagtgcggcttaaaaagcgtagcggaagcggcaaatacgccggttgcgctggtttttggtcgtgagcgtgtcgggctgactaacgatgagttgcaaaaatgccattatcacgtcgcgattgccgctaacccggagtacagctcgttgaatctggcgatggcggtacaggtcatcgcgtatgaagtccgcatggcctggctggcgacgcaggaaaacggcgacgcggcagatcatgaagagacaccgtatccgctggtggacgatcttgaacgtttttacggccatctggagcagacgttgctctccactggctttattcgcgaaaaccatccggggcaggtgatgaataaattgcgccgtctgtttacccgcgcccgcccggaaagccaggagttgaatattctgcgtgggattctggcgtctattgagcagcagaataaaggcaagtaaccgcgttaatgccggatggctcttcgcttatccgacctacaaatcgtgcggcctgtaggccggataagcaaagcgccatccggcacatcaataccgcacggaacgctaaatacctgactaatttactcaagtaaatagttgaccaatttactcgggaatgtcagacttgtccctgctatgcaatacccccattttacaataaaaaaccccgggcaggggcgagtttgaggttaagtaagacatgagactgacatctaaagggcgttatgccgtgaccgcaatgttagacgttgcgctcaactccgaagcgggcccggtaccgttggctgatatttctgaacgtcaggggatttccctttcttatctggaacagctattttcccgtttacgtaaaaacggtctggtttccagcgtacgcgggccgggcggcggttatctgctgggtaaagatgctggcagtatcgcggtcggcgaagtgatcagcgcggttgatgaatccgttgacgcgacccgttgccagggcaaaggcggctgccagggcggcgataaatgcctgacccatgcgctgtggcgtgatttaagcgatcgtctgaccggttttctcaacaatattactttaggcgagctagtgaataaccaggaagttctggatgtgtctggtcgccagcacacgcatgacgcgccgcgcgccagcggtcgtgcgcaggacgctatcgacgttaaattacgcgcttaattaaaatattacgccatctcttctggcggcctcatgcggtgaatgccgcggtcgtctgaaggatgaagcgtaaaaaagaattcagaatcaggccgggacgcggacgtcccgtcaacacggtcgtacatccagccggttgcctgattccttgcattgagtgatgtacggagtttaagagcaatgaaattaccgatttatctcgactactccgcaaccacgccggtggacccgcgtgttgccgagaaaatgatgcagtttctgaccctggacggaacctttgggaacccggcgtctcgttcacaccgtttcggctggcaggctgaagaagccgtcgatatcgcccgcaaccagattgctgaactggtcggcgccgacccgcgtgaaatcgtctttacctcaggggcgacggagtccgataacctggcgatcaaaggcgctgccaacttttatcagaaaaaaggcaagcacatcatcaccagcaagaccgagcacaaagcggtgctggacacctgccgtcagcttgagcgcgaagggtttgaagtgacctacctggcgccgcagcgcaacggcatcatcgatctcaacgagctcgaagcagcgatgcgtgacgacaccattctggtttccatcatgcacgtgaacaacgaaatcggcgtggtgcaggatatcgcgaccatcggcgaaatgtgccgcgcgcgcggtatcatctaccacgttgacgccacccagagcgtgggcaaactgcctatcgacctgagccaactgaaagtggatctgatgtccttctccggtcataaaatttatggtccgaaaggcattggcgcgctgtatgtgcgtcgtaagccgcgtattcgcattgaagcgcagatgcatggcggcgggcacgagcgcggtatgcgctctggtactctgcctgttcaccagatcgtcggcatgggcgaagcttaccgtatcgcgaaagaagagatggagaccgaaatggcccgtctgcgcggtctgcgtaaccgtctgtggaacggcatcaaagatattgaagaagtttacctgaacggcgaccttgagcagggcgcgccaaacattctcaacgtgagctttaactacgttgaaggcgagtcgctgatcatggcgctgaaagacctggcggtctcttccggttccgcctgcacctccgccactctggaaccgtcctacgtgctgcgcgcgttgggcatgaatgacgagctggcgcatagctctatccgtttctctttaggtcgttttaccactgaagaagagatcgactacaccattgatctggttcgtaaatccattggccgtctgcgtgacctttctccactgtgggaaatgtacaagcagggtgtggatctgaacagcatcgaatgggcacatcattaatcggtatcggaatcaggagaatttataatggcttacagcgaaaaagtaatcgatcactatgagaacccgcgtaacgtagggtcgtttgacaacaacgacgataacgtgggaagcggtatggttggcgcgccggcctgcggcgacgtcatgaagttgcagattaaagttaacgatgaaggtatcattgaagacgcgcgcttcaagacttacggctgcggttccgctatcgcctccagttctctggtaacggagtgggtgaaagggaaatccctggacgaagcgcaggcgattaaaaacaccgacattgcagacgaactggagctgccgccggtgaaaattcactgctctattctggcggaagacgcgattaaagccgctattgcggattacaaaagcaaacgcgaagcgaaataaaatagaacgttaacattgaggttttgttatgtcgattacacttagcgacagtgcagcagcgcgagttaataccttcctggccaaccgtggtaaagggtttggtctgcgtctgggcgtgagaacctccggctgctcaggtatggcttatgtactggaatttgttgacgagccgacggcggaagacaccgtgtttgaagacaaaggcgttaaggtagtggttgacggcaagagcctgcaatttctggacggtacacagctggacttcgtaaaagaaggcctgaacgaagggtttaaattctccaacccgaatgtgaaagatgagtgtggttgcggcgaaagcttccacgtgtaactgtgttccgctgttataccgagtcattcgtgctgcagaaaagcggcaagcgagtgaatccccaggcgcttacttaagtaagtgactgggggaacccgcgcagacaacgcatctgcggcgcgaagtaagaaggtataaccccaccgtggtcgcctgcgtgtggggtttgttctgacaggctatccctgagaatgttatggattacttcaccctctttggcttaccagcccgttatcagattgacacccaggcgctgagctttcgttttcaggatctgcaacgccagtatcaccctgacaaatttgccaacggcactcaggcgcagcagcttgccgccgtccagcaatccgccacgatcaaccaggcctggcaaacgctgcgtcaccctttgacgcgcgcggagtatctgctttccttacacgggttcgatctggccagcgagcagcatacggtacgcgacaccgcgtttctgatggaacaactcacgcttcgcgaagagctggacgatatcgaacaatcaaaagacgacgcgcggctggaaagcttcatcaaacgcgtacaaaagatgtttgatgctcgtcttcagcaaatggtggaacagttggacaacgccgcgtgggacgcggcggcggatacggtgcgcaaactgcggtttctcgataaactgcgaagcagcgcagaacaactcgaagaaaagctgctcgatttttaactggaatctaacatggccttattacaaattagtgagcctggtctgagcgccgcgccgcatcagcgtcgtctggcggcgggcatcgacttaggcactaccaactctctggttgcgacggttcgcagcggccaggcggaaacactgcctgaccacgaagggcgccacctgttgccttcagtggttcactatcagcagcagggccatacggtcggttacgctgcgcgtgacaatgccgcgcaggatacggccaacactatcagctctgtgaaacgcatgatgggacgctcgctggcggatatccaggcgcgctatccgcatctgccttaccggtttaaggcaagcgttaatgggctgccgatgattgacacggcggctggattgctcaatccggtacgcgtatctgctgatattctcaaagcgctggccgcgcgggctagcgaatcgctctccggcgagctggatggcgtggtgattaccgttcccgcctatttcgatgatgcccaacgtcagggaacgaaagacgccgcgcggctggcaggcctgcatgtactgcgcctgctcaacgaaccgacggcggcggcgattgcctacggtctggactcaggcaaagaaggcgttatcgctgtttacgatctcggcggcggtaccttcgatatctctatcttacgcctgagccgcggggtgtttgaagtgctggcgacgggcggtgattctgcgctcggcggcgacgactttgaccatctgctggcggactatattcgcgagcaggcgggaattgccgatcgtagcgacaatcgcgttcagcgcgaactgctggatgccgcgattaccgcgaaaatcgccttaagcgatgccgatactgttcgcgttaacgttgcgggctggcagggggagatcactcgcgagcagtttaacgatctcatttccgcgctggttaagcgcacgctattggcctgccgtcgcgcattgaaagatgccggcgttgagccccaggacgttctggaagtggtcatggtcggcggttcgacccgtgtaccgctggtgcgtgagcgggtgggcgaattttttggccgcacgccgttaaccgctatcgacccggataaagtgatcgctatcggcgcagcgattcaggccgatattctggtcggcaacaagccggacagcgaaatgctgctgctggacgtgattccactctctcttgggctggaaacgatgggtggcctggtggaaaaagtcattccgcgcaacaccactatcccggtggcgcgcgcgcaggatttcaccaccttcaaagacagtcagaccgcgatgtctatccatgtgatgcagggcgaacgcgaactggtgcaggactgccgctcgctggcgcgctttgcgctgcgcgggattccgccgctgccggcgggcggggcgcatattcgcgtgaccttccaggtagacgccgatggcctgttgagcgtcaccgcaatggaaaaatccaccggcgtcgaggcctccattcaggtcaaaccttcctatggcctgaccgatggcgaaatcgcctcgatgatcaaggattccatgagttttgccgagcaggacgtgaaagcgcgtatgctggcggagcaaaaagtcgaagccgcgcgcgtgctggaaagtttgaccggcgcgctaactgccgacgccgcgctgttaagcgccgcagaacgtcaatgcattgatgatgccgccgcacatttaagcgcggtcgcacaaggcgatgatgttgacgcaatagaacaagccattaaaaacgtagataaacaaacccaggaatttgccgctcgccgcatggaccagtcggttcgtcgcgcgttgaaaggccattccgtagacgaggtttaacatgccgaagattgttattctgcctcatcaggatctttgtccggatggcgcagttctggaagctgagaccggtgaaaccattcttgacgttgcgctgcgcaacggcatcgagattgaacacgcctgtgagaaatcgtgcgcctgcaccacctgtcactgtattgtacgtgaaggcttcgactccttgccggaaagttcggaagaagaagacgatatgctggataaagcgtgggggctggagccggaaagtcgactgagctgccaggcccgcgttaccgacgacgatctggttatcgaaattccacgttacacaatcaaccatgcgcgtgagcattaacagagggtagtatgggactcaagtggaccgatagccgcgagatcggcgaagcgttatacgacgcatatcctgatgtcgatcctaaaaccgttcgtttcaccgatctgcatcagtggatctgcgaactggacgattttgacgacgaccctaacgcatccaatgaaaaaattctggaggcgattctgctagtctggttggatgaagcagagtaagtcaaataacgggctgccctacgacggcccgtttgctaataaggaaaataacaatgacagaagccatgaaaattacgctttccacgcagcctgccgatgcgcgctggggcgataaagccacttacagtattaataacgacggtattaccttgcatcttaacggtaaagacgatctggggttgatccagcgtgcggcgcgtaaaatcgacggcctgggaataaaacaggtcgcgctgacaggcgaaggatgggataccgagcgttgttgggcattctgggcgggttacaaaggaccaaaaggcgtccgtaccgtaatgtggccggatttagacgatgcccaacgtcaggagctggataaccgcctgaccattattgactgggtgcgcgacaccattaatgctccggcggaagagcttgggccggagcaactggcgcagcgcgcggtggatctgctgtgcagcgtcgcgtgcgatagcgtcacttaccgtatcaccaaaggcgaagatctgcgcgagcagaactatatggggttgcataccgtaggccgtggttctgagcgtccgccggtactgctggcgctggattacaacccgacgggagacaaagatgcgccggtttatgcctgcctggtcggtaaaggtatcacctttgactccggcggttacagtatcaaacaaagcgcttttatggactcaatgaaatccgatatgggcggcgcggcgacagtaacgggcgcgctggcgttcgccattacccgtgggctgaataaacgcgtaaaactgttcctgtgctgcgctgataatctgatcagcggcaacgcgtttaaactgggcgatattattcgctaccgtaatggcaagaatgtcgaagtcatgaataccgatgcggaagggcgactggtactggcggatggcctgattgacgccagcgcgcaacacccgcggctaatcattgatatggcgacgttaaccggcgcggcgaaaacggcgctgggtaacgactaccatgcgctattcagttttgacgatacgctggcggggcgcttgctgaccagcgcggcgcaagagaatgagccgttctggcgtctgccgctggcggagttccaccgtaaccaactgccgtctaactttgcggaactgaacaacaccggcagcgcgacgtatcccgccggggcaagcaccgccgcgggttttctgtcgcactttgttgaaaattaccgcgaaggctggctgcacattgactgttccgccacttatcgcaaagcgccggttgagcagtgggctgccggggcaaccggtctgggtgtgcgcaccatcgcgaatctgctgaccgcctgaacggtgtttttgtaggccgggtaagcgaagcgccacccggcattttgcctgatggcgacgccgtgcgtcttatcaggcctacaacccatatacataatttgtgattcctatgtccgaaactaaaaatgaattagaaattttgctggagaaagcggcgactgagcccgcgcatcgttcggcatttttccgtaccttactggagtccaccgtctgggtgccgggcagcgctgccgaaggcgaggcgattgtggaagacagcgctctggatttgcagcactgggaaaaagaagacggcacgaccgtcattcccttctttacttctctggaggcgctgcagcaggccgtggaagacgaacaggcgtttgtggtgatgccggcgcgcacgctgtttgaaatgacgcttggcgaaacgttattcctcaacgctaaattgccgaccggcaaagagtttatgccgcgtgaaatcagcctgcttctcgctgaggaaggcagtccgttaagtacgcaggaagtgctggaaggcggcgagtcgcttattttatccgaagtggccgagccgccgtcgcagatgattgattccctcactacgctgtttaaaaccatcaaaccggtgaaacgcgcatttctctgcgcgattaaagaacatgcggacgcccaacctaatctgctgattggcattgaggctgacggcgaaattgaagagatcattcacgcagcgggcaatgtggcgaccgacacgttaccgggtgacgaaccgatcgatatttgtcaggtgaggaagggcgcgcagggtatcagccactttatcaccgagcatatcgcgccgttctacgagcgtcgttggggtgggttcctgcgcgattttaaacagaaccgcatcatctgaagaaaagaaagccgcccaacagggcggcctcctggcttacctgctctggacgttgagcgttacgggaacagaattacctgggtagcttctgtctgcgtgaagacacaacgtgccagaaacaagaagcacgacacaaaagcatcgtaccttcatgttgcggtccttgcgaagaccgcatcacggcagcaccgctggcgataatgccgtgatagcaggcactgtggtgtgcctgcgcttacggccatggaacatcctctcctgaagccagtgcccgtttgcgagacggcgaagggggccgggaaagataatacctcaaatgctgaatagtttcgtcgtgaattaacttgactttgctctccttaaaagggagtatttacctactgtggtgtgcctgcgttgctatggcaacaaagcctgctggaaaggccgcgaaccggaccagcacaaaaaaaccgctcaactgagcggtttttttgtggcctgcttaaacagtatttatgtagattcgttttaaatcagcctgaacggtaggccggataagcgtgagcgccacccgacagcatgtcgattaatcgacgagcgcgtccagttttgcccaaaacgcctcatgataatcctccaggtcaagtaaagcggcatcgcgttgttcattcattttttgctgtgccttccattgcggaagatgtaaatcctcttcggtaaagccaatgtctttagcgcccgaaataatattatagagatattccaccagagaagactccgccagccaaaattcattacgttccatgcgggcaatagggtattcgccgttggcatcccgttctgtgatatagataaaaatggcctgatcgccgacatgatcaatacgaattaatgccggaagacggggatcgttactccagacaggcatcagatcttcaatatcaatacctgagctatccatgccagcgccgtaatacgcctcttcatcaggagagtaagaatgtattactccctcgttatcaataaatctttgtaatgtttcaatcacaggcatattataattgctaagtagatcgcggtcgtaggccagtagcgccttcaggctttcaggtaactcagtggtttccgtattttgcggatcgcgatacttacgcactcgcagacaacttatttcctcggcaggcataggattaggcaccttattgcggttaacctttttaactagctccattaaattagtgagtgaaatatccattttccatccttaaaaaattatatttacaggagttatttcccggtgaaacccaaaacagcggtgatgatactccttatacccgacgtaaagtatttaccgataaaaaataggattttattaagagaaaataatgcccgtttgcaggacagtggaaaagagcggaataaaaacaatgtctgtagatcgttttacatcagcctgaacggtaggccggataagcgtgagcaccatccggcatggcggatattaagcgggttcaaccggtaaatcggtacgcgcgccccattcgctccacgcgccgtcgtaaagcgtgacgtcaggcacatccagcgtggcgagtgccagcaccacgaccgcggccgtcacgccggaaccgcaactggcgataatcggtctgtcgaaactcacgccgtggctgaaaaaaacctcattcagttcgtcagtggtctttaattcgccctcatacaccagttccgtccacgggacgtttagcgcgccaggaatgtgtccgcgtctcagtcccggacgcggttcatcagcctgagcgttaaaacgcgccgccggacgcgcgtcgacgatttgcgcggttttttcatggcttgccagcaatacgtcggtgagacgcaccacggcttgcggcgtgaatttcgcctcaaactcgcctccttcatgcgcttcttcgccttcgcgcaatagccattcgtcgcgctgccagcccgccagtccgcccgccagaatggacactttctcggcaccgaacgtgcgcagcatccaccatgctcgcggagcggagaacagattgccttcatcgtatatgaccaggtgtttatcctggcgaacacccagttcacgcatggccaccgcaaacgcttccgggcgcggcatcatatgcggcagcggcgatgcgcgatcggaaagcgcttcaatatcaaaaaacagcgcgccgggaatatgtccggcgcgatattcgcccgccatatcacgatgttcctgtcctggtggcgccatacgggcgtcaagaatctgtatttccggatcatcaatatgttcggcaagccagtcggcggcgacaaaaaaggcggtggtcatgggcatctccattgttacctgattatggtcaaattgtcggacgtttcccgaaaagggacaagtagaagaggctgttttggctggcgaaaccacatttctgcgtaaaattttcgcgtcatcacagtaatacggacttacacaataaaatttctcgcgcataatatctcatcaaccgttgctgacaggccgttaaggccagggatgaaagatgaaacatttacgcgtggtggcctgcatgatcatgctggcgctggcgggatgcgataacaacgataaaaccgccccgacgactaaaagcgaagcgccagccgtagcgcagccctcgcccgcgcaagacccgtcacagctacaaaagctggcgcagcaaagccagggcaaagcgctcacgctattagacgcctccgaagcgcagctcgacggcgcggcgacgctggtgctgacgttttcaattcctttagatcctgaacaggatttctcccgtgtggttcacgtggttgataagaaaagcggcagcgttgacggcgcatgggagctggcgccaaatttaaaagagctaaggttacgtcatctggaacctgagcgcgtgctggtggtcacggttgatcccgccgttaaagcgctgaataacgccaccttcggcaagtcttatgaaaaaacgattaccacgcgtgatgtccagcccagcgtcggctttgccagccggggatcgctgctaccggggaaaatagcggaaggactgccggtcatggcgcttaacgtcaaccacgttgatgtgaactttttccgcgttaagcccggatcgctggcgtcgtttgtcagccagtgggagtaccgtagttccctctctaactgggaatccgacaatctgctgaaaatggcggatctggtttataccggtcgttttgatcttaatccggcgcgtaatacgcgtgagaaactgctgctgccattaagcgatattaagccgctgcaacaggcgggcgtatatgtggcggtaatgaatcaggctggacactacaactatagtaatgccgctacgttgtttacccttagcgatatcggcgtgtccgcgcaccgttaccatagtcggctggatatctttacgcaaagcctggaaaacggcgcggcgcagtcgggaattgagatcgttcttctgaatgataaagggcagacgctggcgcaggcgacgagcgacgcgcagggacatgtgcaactggaggctgataaagcggcggcgctattactggcgcgtaaagaggggcagaccacgctgctcgatctcacgcttccggctctggatctgtcggagtttaatgtcgctggcgcgcccggctacagcaagcagttctttatgttcggcccacgcgatctctaccgaccgggcgaaacggttatcctcaacggattactgcgcgatagcgacggtaaaacgctgcccgatcaacccgttaagctggaagtggtaaaaccagacggacaagtgatgcgtaccgtcgtcagccagccggaaaacggactataccgtttgaattatccgctggatatcaacgcgccgaccggcttgtggcatgtccgcgccaacaccggcgataatttgctgcggagttgggatttccacgtggaagactttatgccggagcggatggcgctcaacctgacggcgcaaaaaacaccgctggcgcctgcggatgaggtgaaattctccgttgtcggctattacttgtatggcgcccctgctaacggcaataccctgcaagggcaacttttcctgcgtccgctgcgcgacgctgtcgcggcgttgcctggcttccagttcggcaatattgccgaagagaatctttcgcgcagcctggacgaagttcaactgacgttggataaaggcggacgtggtgaagtgagtgctgccagccagtggcaagaagcgcattcgccgttgcaggtaattctacaggccagcctgctggagtctggcggtcgtccggtcactcgtcgcgtagagcaggcgatttggcctgccgatacgttaccgggaattcgtccacagttcgccgccaaagcggtatacgactaccgtacggataccaccgttaatcaaccgattgtcgacgaagacagcaacgccgcattcgatattgtttacgccaacgcgcagggcgagaaaaaagcggtgtccggtttacaggtgcggctcatccgcgagcgtcgcgactattactggaactggtcggaaagcgaaggctggcagtcgcagtttgatcaaaaagatctggtggagggcgagcagacgctggatctgaacgcggatgaaaccggaaaagtcagcttcccggtggaatggggcgcgtaccgtctggaggtcaaagcgccgaatgagacggtcagcagcgttcgtttctgggccggctatagctggcaggataacagcgacggtagcggcgcggcgcgtccggatcgcgtcaccctcaaactggataaagcgaattatcgtccaggcgacaccatgaaattgcatatcgccgcgccggtcgccggtaaaggttatgccatggtggagtccagcgatggtccgctgtggtggcaggcgatcgacgtgccggcgcaggggctggagctcacgattccggtggataaaacctggaatcgccacgatctctatctcagtacgctggtggtgcgtcccggcgataaatctcgttccgcgacgccaaaacgcgccgtggggttactacatctaccgctgggggatgacaaccgccgcctcgatctggcgctggaaagcccggctaaaatgcgcccgaatcagccgctcaccgtcagggtgaaagccagcgttaaacacggcgaaatgccaaaacagatcaacgtgctggtctccgcggtcgatagcggtgtattgaatatcaccgattacgcgacgccggacccgtggcaggcgttcttcggtcaaaaacgctacggtgcggatatctacgatatttacggccaggtcattgaagggcaggggcggctggcggcgttgcgttttggcggcgatggcgacgaccttacgcgcggcggaaaaccgccggtaaaccatgccaatatcatcgcgcagcaggcgcagccgatcacgctcaatgagcagggcgaaggggtcgtaacgctgccgattggcgactttaacggcgaactgcgggttatggcgcaggcatggacagcggacgattttggtcgcggcgaaagcaaagtcgttgtcgccgcgccagtgattgccgagctgaatatgccgcgttttctggcgggaggggatgtttcgcgactggtgctggacgtcaccaatctgaccgaccgcccgcagacgctgaatattgcgctcgccgccagtgggttactggaactgcttagtcaacagccgcaaccggtcaacctggcgccgggcgtgcgcaccaccttattcgttccggtacgcgcgctggaaggttttggcgaaggcgaaatccaggcgaccattagcggtctgaatctgccgggagaaaccctcggcgcgcagcataagcagtggcaaatcggcgtgcgtccggcctggcctgcccaaacggtaaatagcggcattgcgctggcgccgggagagagctggcatgtaccagagcagcatctggcaaacgtctcgccagccacgttacagggacaactgctgttaagcggaaaaccgccgctcaatctggcgcgctacattcgcgagctgaaagcatatccgtacgggtgcctggaacaaaccaccagcgggttattcccggcgctgtataccaatgccgctcaattgcagtcgctcggtattaccggcgatagcgatgaaaaacggcgcgccgcggtggatatcggcatctcccgcatactacagatgcagcgtgataacggcggttttgcgctatgggatgaaaatggggcggaagagccctggctaacggcctacgcgatggatttcctcattcgcgcgggcgagcagggatatagcgtcccgccggaggccattaaccggggcaatgagcgactgctgcgctatctgcaggatcccggtacgatgctgattcgttatagcgataatacccaggccagtacttttgccgctcaggcttacgccgcgctggtactggcgcgtcagcagaaagcgccgctcggcgcgctgcgcgaaatctgggagcgccgtagtcaggcggcttcaggactgccgctgatgcaattgggcatcgcgttaaacacgatgggtgatgccagacgcggcgaagaggccattacgctggctctgaatacgccgcgtcaggacgaacggcaatggatagcggattacggcagttctctgcgcgataacgctctgatgttgtcgttactggaagagaacaacctcagaccggacgcgcaaaacgcgctattaagctcgctttctgagcaggccttcggtcagcgctggctctctacccaggagaacaatgccttgttcctcgccgcgcattcgcgacaggccagcgcgggcgcctggcaggcgcagacctcgttagaggcgcagccgctgtcgggcgacaaggcgctgacccgtaatctggatgctgatcagctggccgcccttgaggtgacgaacaccggtagccagccgctatggctgcgtctggatagcagcggctatccctcatctgcgcctgagcctgccagcaacgttttgcagattgaacgacaaatactggggaccgatggtcagcgcaaatcgctgtcctcgttgcgtagcggcgaactggtgctggtctggttaacggtagtggccgatcgcaatgtgccggatgcgctggtggtggacctgctcccggccgggctggagctggaaaaccagaatctggctgacagcagcgccagcctgccggagagcggtagcgaagtgcaaaatctgcttaatcagatgcagcaggcggatattcagtatatggaattccgcgacgatcggtttgtggctgccgtcgttgtcaatgagggccagcccgtgacgctggtctacctggcgcgcgcggtaacgccggggacgtaccagcttgcgcaaccgcaggtggaatcgatgtacgcgcctcagtggcgggcaaccggcgcgagcgagggactgctgattgtgacgccttaaatgaacggttggcgtggtaaacgtggccgctggctgtggctggcgggcgcgccgctttttattttcctggcgttatgggcagcggataaactctggccgctgccgctcaatgaggtccatcctgcgcgggtcgtggtcgcccatgacggtacgccgctgtggcgctttgccgacgccggggggatctggcgttatccggtgacgattgaagaggtctctccccgttacctggaggccttaatcaattacgaagatcgctggttctggcagcaccctggcgttaaccctttttccgtcgcgcgcgcggcatggcaggatcttaccgccgggcgcgttatttccggcggcagtacgctgactatgcaggtggcgagacttctggacccgcattcgcgcacgttcggcggtaaaatccgccagctttggcgcgccctccagcttgaatggcatttgtccaagcgcgatatcctgacgttgtacctgaaccgcgcgccgttcggcggcacgctacagggtattggcgctgcaagctgggcctacttcggcaagccgcccgcgcgcctgagctacgctgacgcggcgctgctggccgtattgccgcaggcgccgagccggttacgccccgaccgatggcctacgagagccgaagcggcacggaataaagtgctggatcggatggcggagcagggcgtctggcctgccgaaacggtacgcgagtcgcgtgaagagccggtctggctggcgccgcgtcaaatgccgcaactggcgccgctttttgcccgaatgatgttgagtaaaagccggagcgacaaaattgtgaccacgctggacgccgggttgcagcggcaactggaagatctggcgcgggcatggaaagggcggctgcctgcacgcagttcattggcgatgatcgtcgtcgatcataccgatatgagcgtgcgcggctgggtaggatcggtagaccttaatgacgacagccgttttggtcatgtcgacatggtaacggcgatccgatcgccgggatcggtactcaaaccctttgtgtatggtctggcgctggatgacggcttgatccatcccgcatcactattacaggacgttccgcgccgcaccggagattaccgcccgggaaacttcgatagcggatttcacggcccggttagcatgagcgacgcgctggtacgctcgctgaatctgcctgccgttcaggtgcttgaagcctatgggccgaaacgatttgcggcaaaactgcgtaacgtcggcctgccgctatatttgcctgctggcgcggcgcccaatctttcgctgattctgggcggcgcgggcgcgcggcttgacgagatggcggcggcatacagcgcgttcgctcgtcatgggaaagcggcgaaactacggttacagccggacgatccgctgtcggaaagaccattaatgtcgccgggagcggcgtggatcattcgacggattatggcggatgaagcgcaacccttgccggataacgcgctgccgcgcattgtgccgttggcgtggaaaaccggcaccagctacggctatcgcgatgcgtgggctattggcgttaacgcgcgctatatcatcggcatctggacaggcagacccgacggcacgcctgtggtggggcaatttggttttgccagcgcggtgccattgcttaaccaggtcaataatctgttactggcgcatacgggacgcctgccggaagatccgcgtccgcagacggtaagccgcggcgtcatttgctggccgggcggacagactctgcctgccgggaacagcaactgtcgccgccgactggcgacatggctgcttgacgacagccagccgcccacgctgctgttacctgagcaggaagacatcaacggtattcgtttcccggtctggctggatgatacggggcggcgtgtcgctgccgactgtccgcaggcgcgtgcgcatacgtttatcgtctggccgcggccgctggagccgtggctgccgcctgcggaaagacgtagcgcccgcttgcccgcggcgtccgaccactgtccgccgctacagggcaatgatgccgcgccgttaatgctgtcaggagtgagggatggcgcggtgatcaggcaattgccaggccaggaaaacgtcacgctgcccgtctcgactaccggcggcaaagggcgtcgctggtggtttttaaatggcgaacctgttaatggcgaaaataatcgcctttctttattactcaatatcgctggacgttatcaacttgtcgtaatggatgagtccggtcaggttgcagcggttaattttgaattaatacgttaaccattctccaaaatagattatcaattccttttaatttaagcttaatgataattgttaattattactggatcatacataaccggagagcttgataaatatcaagagaaccaacgcataaaaacgtgagaatgggtttttatttgacgagtcggatcatgaaaaatataaaaagccagggaaatggcgaacagcccgctatttctcgccgccattttatccaggccagctccgcgcttattgagttaccgtttgtctcctcgccagctaccgctcaggcgcgcgctgtgacggcaactgaaaacaggcctgcggaaaaagtcgttcagacatgcagcacttttgactgcgggggcaaatgcgatattcgggcgcatgtcagtgacggtatcgtgacgcgaatttcaacgcgaccggataacgcgctggatgcgcaaatgccggtgatgcgtgcctgtgttcgtggacgagcataccgtaaatttgtttatcatcctgacagacttaaatatcccatgaagcgcgtaggaaaacgcggtgaaggaaagttcgagcgaatttcctgggatgaagcgacaaccttaatcgccgataatttaaaatcgattactgaaaaatatggcccggcttcgcgctatgttcatgttggtaccgccgtttccggcggcaccttttccggcgataaaatggcgcgtcgcctgctgaatcttaccggcggctatctcgaaagctaccattcggtgagtatgggcaacacggtggccgcgacgccttatacttacggcattgccgccagcggcagttcgctggatacgcttttggacaccaaactggtgattctgtggggccataacccgacggagaccatttttggtcataccaactatttcttgcagaagatgaagcagaacggtacgcggtttatcgtggttgatccgcgctattccgacaccgtttcgtcgctggcggatcagtggatcccgctgctgcccaccaccgacaatgcgctgatggacgcgatgatgtacgtcatcatcagcgagaatctgtacgatcgtgcatttattgcgcgctacgctatcggttttgacgaagactcaatgccggaaggcgtaccggctaacgaatcgctggtggcatatctgaccggcgccaaagacggtgtcgttaagtctcccgagtgggcggaaaagatcacccatgtgccggcgcaaaccattcgccagttagcgcgtgattacgcgaagaccaaacctgccgcgttgattcaggggcggggccacagcgccacaactgcggcgagcgcaccgcgcgcggctcgactctactggcgaccattaccggtaatgtcggcatcaaaggcggttgggctgcgggttacggcggctgcgctaaccgtaaatttgccgcgggtccggagatgccggataacccggtaaaagccaaaatttcggtgatgaactgggtgcaggccgcagacgacgccagcaaagtgacgccggatatggggctgaaagatgccgataagctggacagtaacatccgtattctgttctcgctggccgggaactatctggcgaatcagaaccccgatctgcaccaggcggtacgcgtactggaggatgaatcaaagatccagtttattgtcgccagcgatctgtttatgacgccgagcgcgaaatacgccgatctactgctgccggaaaccagctttatggaacgttggaacatcggtgaaacttggggcacggcaagctacctgatactctctgaaaaactgatcgagcctgaatttgagcgtcgctccgactacgactggctacgtgaggtggcggcgaaattaggcattgagaatgaatttagccaggggcgcgatgagaaagcgtggattgaacacatctgggaacagacgcgcctggcgatgccggacgaaaatctgccggattttgccacactgcaaaagacccgtcagcatctgttcaaaagcgcgccatttatcgcctttgaagacaatattcgcgatccggacaatcatccgttcccgacgccgtcagggaaaatagaggtcttctcgaagcgcctgtacgacatgcagcatccggaaatcccggcgttgtcgcactacgttcccgcgcatgaaggcccggaggatgcgctggtgaaagattttccgctccagttaattacgtggaaaggaaaaaaccgcgccaactcaacgcaatacgctaacccgtggctgattgaagtgcagcagcagacattgtggatcaacccgcaggatgcgcaaacgcgcggcattacgcatggcgacatggtgcgcattcataactcacgcggaatttgcgaaatcccggcggaagtgacgccgcgcattattcccggcgttgtcgcgatgcaggctggcgcctggtggcagccggatgagaacggtattgataaaggcggctgcgcgaacgtcctcagctcggcccgtattaccgccctggcgaagggaaattcacatcaaaccatgctggtggaggtggcaaaagcatgagccagtttacacattacccgccggtgagcgataaacaactgggatttttcatcgactcctcacgctgctccggttgtaaagcctgccaggtggcctgcaaagacaaaaacaatctggaagtaggccgtcgtttccgccgcgtctatgaagtcaagggcggaagtttcatcccgaccgggcagggcggggtcagcaataacgtatttgcttatacgctttctatttcctgcaaccactgtgcggatcctgtctgcaccaaaaattgcccgactaccgctatgcataaacgcccaggtgacggcattgtgcgcgttgataccgacaaatgcgtcggctgtggctattgcgcctggtcctgcccttatggcgcgccgcagcttaacgagcagaccggccaaatgtccaagtgcgacatgtgcgttgatttactggcgaaaggtgaatcgcccggctgtgtcgcgacctgtccgctggaggccatcaagtttggcccgattgatgaactgcgcgcgaagtacggtagcgtatgcgacgttaacgggctgccagattcatccataaccaaacctaatctggttgtcaaagcgcatcagggcgcagaaaaagagggtaaacgccatgcatgagttaccgctgctgatttttacgctctgtttgcaagggtccgtgggcgtgactctgtggctggcgctgggccgtcagtacgccgtagagggacgcgtacctgcgcgcggcgcgcttcccgcgatggcgggggcgtttgtactggcctgcgtggggctgcttgcttcagcgctgcacatgggctatcccctgaatgcgctaaacgcgttacgtcatgtcgccagttcgtggctgagtcgcgaaatcgtctttgccagcctttatctggcggcgctggggctgggggttgtgctgctgtttttccgaaagcctggctggcagccgctgctggcgctggcggcagcgttcgggctggtggatgtattctgcatggcgcaggtttatatccatgcctcggtggcgacctggcagcatagcaacacgctggcgctgttctttggcacgtcaggcattatcggctcggtagtcattgcgctggcttatctgcgcaacgctggcgccgcaatgcgctgcgctgtggtggtggtcgcactgatggtgctgattcgcctgatcatgcagccgctatggttggcggatattaatgcagtggatacgacggtcgtcactttcccgcatcatccgctacaggcgctggcgcagttgcgcgacatctatcttctcggctggtgtgtctcagcggcgggaatgctctgctttgccgcaggcggtctgcgaaacgccagagggacgctggtggcgggcagcgtattgctgcttatcggcgagattatgctgcgctacgtcttctttagtattggctgatggttaacctgacgatcgatccggcggtagacgtgacgcaggcctgcgtccgtcgtcgctttcgtttttcttcctgccgcgcttgcactgatgtttgtccggcgcaggtgttttcgctggcgcaggggcaggtcagcatagatacgacgcgctgcatagcctgtggcgactgtctgtttgtctgtcctgttgacgccattaccgatatcaaaccggttaaacgctttgtgcagggggatacgttggtggggccgttttcgctacaggcgccaacggtcgatgaactgcttctctggcacagccagtacggtattcgctttattgatattgcggtggagcgatcggcgcagtggctgatggcgttggcggggctaaatttagcgctgcgccgctacggcgagccgggctggtctttcaaacacgttgtcggcgcggaaattaatgcctcgcggcgcactctgtttcatgttccgcgcgacgccattaccccgtgcgccgtcgagccggggaaacggcgtctcagacaggcgttttccgcgttcagcgaatgcgtacccgaaatcagtccgcaagagtgcaggatgtgcggcgcctgctggcgaagctgcccggaaaacgttatccagtttgacgacgacacgctgacgatagcggcggcgcgttgtacgggatgcggcggctgtgcggcggtatgtccgcatcaggcgctgcggctgcggtttgacgtggaacccgcctcaacgcggcatagtgcggtgcatacgctcacctgcgaaagctgcaaacgtactttccatgctctcacgcctgaacacacgcactgcgtgctgtgtcagtcccctgagtttgctgtgcgcctttaacttttgttgctaatgctcattttattttaaaaaaatgttacctgcatccataggcaattgatgggatgctctttataatccgcgcctgacataacaacagaacatatttcagaggtaaacatggctattgaacggactttttccatcattaaacccaacgcggtggcaaaaaacgttattggcagcatctttgcgcgctttgaagctgcagggttcaaaattgttggcactaaaatgctgcacctgaccgttgagcaggcgcgcggcttctatgctgagcacgacggcaagccgttctttgacggtctggtggagttcatgacctctggccctatcgtggtatccgtgctggaaagtgaaaatgcggtacagcgtcatcgcgatctgcttggtgccaccaatccggcgaacgcgttggcggggacgctgcgtgctgattacgctgacagcctgaccgaaaatggcacccacggttcggattcgctggaatccgcgcagcgcgaaatcgcctttttcttcggtgaaggcgaagtgtgcccgcgcacccgttaatctccttcgtctttcacgctgtaaatgcgttggcgataaattatcggttcaaatattatttttgctaatgccgcgtgcagacgtggcatccttacgccagaatttgtacaatgcagcgcccccggacgagcagtaagcttaccggggcgtttcttttttcaaccctccaggggccataacgtgtaataacgaggccggaatagcatatgtctgaacaaattgtcacacctgaaagcagtaccccggtagttcttaacaacgaaacaaaaatcaacctgctggatctaaaccgtcagcagatgcgcgagttttttaaaaacttaggtgaaaaacctttccgcgccgatcaggtgatgaaatggatgtatcactattgctgcgataattttgatgagatgaccgacatcaacaaagtgttgcgcggcaaattaaaagaggtcgcggaaattcgcgcgccggaggtcgttgaagagcagcgttcttcagacggcaccatcaagtgggcgattgctgtcggcgatcagcgcgttgaaacggtctacatcccggaggacgaccgcgctacgctgtgtgtctcttcacaggtagggtgcgcgctggagtgcaaattttgttcaactgcgcagcagggctttaaccgcaacctgcgcgtatcggaaattatcggtcaggtctggcgtgcggcgaaaatcgtcggcgcggccaaagtcaccggccagcgtccgatcaccaacgtagtcatgatgggaatgggcgagccattgcttaacctgaccaatgtcgtaccggcgatggaaattatgctcgatgactttggtttcggcctgtccaaacgtcgtgtcacgctctcaacgtccggcgtggtgcctgcgctggataaactgggcgatatgatagacgtcgcgctggctatctccttacatgcgccgaatgacactattcgcgacgaaatcgtcccgatcaacaaaaaatataatatcgaaacgttcctgggcgcggttcgccgctatctggagaaatccaacgccaatcaggggcgcgtgacgattgaatacgtgatgcttgaccacgttaacgacggcactgaacacgcgcatcaactggcggagctactaaaagagacgccttgtaagattaatctgattccgtggaacccgttccctggcgcgccgtatggccgcagctctaacagccgtatcgatcgcttttctaaagttttgatgagttatggtttcacgaccatcgtacgcaagacgcgtggcgatgacattgatgcggcatgcggacagttggcaggcgatgtgattgaccggactaaacgtactctgcgtaagcgtatgcagggagaggtgattgacatcaaggctatttgatagcagttgcgccacggggcattcattataccgtggcgcaatgtcagttgaataatgtctggcgttgtacttgtctggtcaataataacggtgcgtttttgtcgactttaaggcagtatgtaacgatgcaacaagagtttaaccttgtgtcttaagcggttttgtcatctgcggcctgacaggcttatactgtctgactaaaggttaactaacctgatgtttcgcggtgtgggcgggcattacggctcgtcggcgcctgaatcctaatttacacgtacctgtagctgtagcgaatgaatactgaagccacgcacgaccaaaatgaagcacaaaccaccggcgttcgtctgcgcaatgcccgtgaacaactcggactcagccagcaggctgtcgctgagcgactttgcctgaaggtttctacggtacgcgatattgaagaagataaggcgccgtccgatcttgcttcaaccttcctgcgcggatatatccgctcatatgcgcgtctggtgcatgttccagaagaggaactgctgccggggctggaaaaacaagctccgctgcgcgccgctaaagtcgccccgatgcagagtttctcattaggaaagcgtcgtaaaaaacgcgacggctggttaatgtcttttacctggctggtactgtttgtggtcgtagggctgaccggcgcctggtggtggcagaaccacaaggcgcagcaggaagagatcacgacaatggccgatcaaagcacggctgaactgaacgcagataaagacagcggccaaagcgtaccgctggacaccagtgccgcgacaagccaggatacgacgccagcgcaaacggctccggctcctgcgacgccggttgattcgacggcggcaacgcaaaatacggtagtcgcgccttcgcaggcgaatgtcgatacggctgcgacatctgccgcgccagcggcaacggaaacgccgtccgcgctgccgaccagtcaggctggcgtagcggcgcctgctgccgatccgaacgcgctggtgatgaattttaccgctgactgttggctcgaagtcactgacgccacgggtaaaaaactgtttagcggtatgcagcgtaaagatggcaatttaaacctaaccggtcaggcgccttataaacttaaaattggcgcgccggccgcggtgcagatccagtatcaaggaaaacctgtcgatctgagccgctttatcagaactaatcaggttgcgcgtctgacccttaatgccgaaccgacaccggcgcagtaacagacgggtaacgcgggagatttttcatgcataaccaggctccgattcaacgtagaaaatcgacacgtatttacgttgggaatgtgccgattggcgatggcgcccctatcgccgtccagtcgatgactaacacgcgtaccactgacgtggaagcgacggttaatcagatcaaagcgctggagcgcgttggcgcagatattgttcgtgtttctgtaccgaccatggacgccgccgaagcgttcaagcttatcaaacagcaggttagcgtcccgctggttgccgatattcacttcgactaccgcattgcgctgaaagtagcggaatacggcgttgactgcttgcgtattaaccccggcaatatcggtaacgaagaacgcattcgcatggtggtggactgcgcgcgcgacaaaaacatccctatccgtatcggcgtaaatgccggatcgctggaaaaagatctgcaggaaaaatacggagagccgacgccgcaggcgctgctggaatcagccatgcgccatgtcgatcatctcgatcgtctcaactttgatcagttcaaagtgagcgtaaaagcgtccgatgtattccttgccgttgagtcttatcgtttgttggctaaacagatcgatcagccgctgcatctggggatcaccgaagcgggcggcgcgcgtagcggggcggttaagtcggcgatcggtttaggtctgctgttatcggaaggcatcggcgacacgctgcgcgtatcgttggcggccgacccggtggaagagatcaaagtcggtttcgatatcctgaagtcgctgcgtattcgcgcgcgcggcatcaatttcatcgcctgcccgacctgttctcgtcaggagttcgacgttatcggcacggtgaacgcgctggagcagcgtctggaagatatcatcaccccgatggacgtctcgatcatcggttgtgtggtgaacgggccgggcgaagcgctggtatcgacgctgggcgtgacgggcggcaataagaaaagcggcctgtatgaagacggcgtgcgtaaggacagactcgataacgacgatatgatcgcgcagcttgaatcccgtattcgcgcgaaagtaagtcaacttgatgaagcgcgtcggattgacgtgctgcaggttgaaaaataagaacgtgatgggaagcggcgcgcttcccgtgtatgattgaacccgcatggctcccggttcgttcggggaagcgctgagggttcatttttatattcagaaagagaataaacgtggcaaaaaacattcaagccattcgcggcatgaacgattatctgcctggcgaaaccgccatctggcagcgcattgaaggcacactcaaaaacgtgctcggcagctacggttacagtgaaatccgcttgccgattgtagagcagaccccgttattcaaacgcgcgatcggtgaagttactgacgtggttgaaaaagagatgtacacctttgaggatcgcaacggcgatagcctgacattgcgccctgaaggtacggcgggctgtgtacgcgccggcatcgaacatggtctcctgtacaatcaggaacagcgtttgtggtatatcgggccgatgttccgtcatgagcgtccgcaaaaaggccgctaccgtcagttccatcagctaggcgccgaagtctttggcttacaaggcccggatatcgacgcggaactgattatgctgaccgcacgctggtggcgcgcgctgggcatctctgaacacgttagcctggagctgaactctattggttccttagaggcgcgtgcgaactatcgcgatgcgctggtcgcgttcctcgaacagcatcaagagacgctggacgaagactgcaaacgccgtatgtataccaatccgctacgcgtgctggattcaaaaaatccggacgtgcaggcgctgctcaacgacgcgcctgttctcggcgactatctcgatgacgattcacgcgagcactttgccggcctgtgtaaattgctggacgcggcggggattgcctacaccgtcaaccagcgtctggtacgcggtctggattactacaaccgcaccgtatttgaatgggtaacaaacagtctggggtcacaaggcaccgtctgtgcgggtggtcgttatgatggtctggtggaacaactgggcggtcgcgctaccccggcagtgggctttgcgatgggcctggaacgacttgttttgttagttcaggcagttaatccggaatttattgcctctcctgttgtcgatatatacctggtagctgccggcgcacaaacgcagtctgcggcaatgacgctggcggagcggctgcgcgatgaaatgccaggcgtgaagctaatgacaaaccacggcggcggcaactttaagaaacagtttgcccgcgccgataagtggggcgcccgtattgcactggttcttggcgaatctgaagtcgccgatgggactgttgtagtgaaggatttgcgctccggtgagcaaacggcagtggcgcaggacagcgtcgccgcgcatttgcgcactttattgggctaaggagaaggacagcgtggaaatttacgagaacgaacacgaccaggtggatgcgattaaacgcttctttgccgaaaacggcaaagcgctggctgtcggagtgattttaggggttggcgcgctggttggctggcgttactggagcagccatcagacggagtccgcgcgtgctgcttctctggcgtatcaaaatgcggtgacggcggtaagcgccgataagccggatagcattcccgccgctgaaaaattcgcggctgagaataaaaatacctatggtgcgctggcgtctatggaactggcgcagcagtttgtggataagaatgaacttaaaaaagccgaagcccagttgcagcaggggttggcggccaccagcgatgaaaatctcaaagcggtgattaatctgcgtctcgctcgcgttcagttacagcttaagcaagctgacgccgcgctgaaaactctggatgccgttaaaggcgaaggatggacggcaattgtcgctgatttgcgcggcgaagcgttgctgagtaagggtgataaaaaaggcgcgcgcagcgcatgggaagcgggcgtcaatagcgatgcttctccggcgttgagcgaaatgatgcagatgaaaatcaataatttgtccatctgagagggacccgatgcaattgcgtaaattacttctgccagggttgctttccgttaccctgctcagcggctgttcactgtttagcggcgaagaagatgtcgtcaagatgtctccattaccgcaggttgaaaaccagtttaccccgaccactgtctggagcacctctgtcggtaacggaattggtgaattttattctaaccttcatccggtaatggcagataacgtggtctatgcagccgatcgcgcgggcgtggtaaaagcgctcaatgcggatgatggcaaagagatctggtctgtgaatctgggcgagaaagacggctggttctctcgttcgtccgcgctgttgtccggcggcgtcactgtcgcgggcggtcacgtctatatcggcagtgaaaaggccgaggtttatgcgctgaataccagcgacggtaccacagcatggcagacgaaggtcgcaggcgaagcgttgtctcgcccggttgtcagtgatggaatcgtccttatccataccagcaacggtcagttgcaggcgctaaatcaggcggatggcgccattaaatggacggtgaacctggatatgccttcgctgtcgctgcgcggcgaatctgcgccggcaaccgcgttcggcgcggctatcgttggtggtgataatggccgcgtcagcgccgtgttgatgcaacaagggcagatgatttggcagcagcgtatctcccaggccactggcccaacggaaattgaccgtctgagcgacgtcgataccacgccggttgtggtaaacggcgtcgtttacgcgttggcgtataatggtaacttaacggcgctggatctgcgcagtggtcagattatgtggaaacgcgagctggggtcggtcaatgactttatcgtcgacggcgaccgtatctacctggtcgatcagaacgatcgtgtgctggcgctgaccactgacggcggcgtaacgctgtggacgcaaagcgatctgctgcaccgtttgctgacctccccggtactgtataatggtgatttagtcgtcggcgatagcgaaggttatctgcactggattaatgtcgatgacgggcgttttgtggcccaacaaaaagtagacagttccggttttctgaccgaaccgacggtggcggatggtaaactgctcatccaggccaaagacggtacggtctacgcgattacgcgttaatcgtcacggttgtgcgtttgaaaaaacggctcctggtgtaggggccgttttcctgtttttaacaacggcgtaaaaatgacgcgcgttgtctgatgattttttaaatgaggctttaaacatggtacctgtggtcgcgcttgtcgggcgccctaacgtcggaaaatccacgctatttaaccgtctgacccgcacccgagatgcgttggttgcggatttcccgggtctgactcgtgaccgtaagtacggtcgtgcggaggttgaaggccgcgagtttatctgtatcgacaccggcggtattgacggcaccgaagacggcgtcgaaacgcggatggcggaacagtcgctgctggcgattgaagaagcggatgtggtgttattcatggtagatgcgcgcgctggtctgatgccggcggatgaagcgattgccaaacatctgcgctcccgtgaaaaaccgaccttcctggtggcgaataaaacggatggtctcgatcccgatcaggcggttgtcgatttttactcgctgggattaggcgaaatttatcctatcgccgcctcacatggtcgcggcgtattgagcctgctggaacatgtgcttctgccgtggatggatgatgtcgcaccgcaggaagaagtggatgaagacgcggaatactgggcgcagttcgaggcggaacaaaatggcgaagaagcgccggaagatgattttgacccgcaaagcctgccgataaagctagcgattgtcggtcgcccgaacgtaggtaagtccacactcactaaccgtattctcggcgaagagcgcgtggtggtatacgacatgccgggcaccactcgcgacagtatttatatcccgatggaacgcgacgaacgggaatatgtgctgattgacacggcgggggtgcgtaagcgcggaaaaatcaccgatgcggtagaaaagttctcggtgattaaaacgttacaggcgattgaagacgctaacgtcgtactgttggttatcgatgcgcgcgaggggatctctgaccaggatttgtctctgctgggctttatcctcaatagtgggcgctcactcgttatcgtagtcaacaaatgggatggcctgagccaggaagtcaaagagcaggtgaaagagacgctggatttccgtctgggctttattgattttgcccgcgtgcactttatctctgcgctgcacggcagcggtgtcgggaacctgtttgagtccgtacgcgaggcttacgacagttccactcgccgggtgagcactgcgatgctgacccgtatcatgacgatggcggtggaagatcatcagccgccgctagtgcgcggtcgccgtgtgaagctgaaatatgcccacactggcggctataacccgccgattgtggttattcacggcaaccaggtaaaagatctgccagactcctataagcgctatctgatgaactacttccgcaagtcgttggaagtgatgggtacgccgattcgcattcagtttaaagaaggggagaacccgtatgcgaacaagcgtaacacactgacgccaacgcaaatgcgcaaacgtaagcgtctgatgaagcatatcaagaaaagcaagtaatgctttttcagtaatattccaggcctgataagcgcagcgctatcaggcctttcaagtaaaagcgagtcacgcgcctgaggagaatgttatggaaataatctgccctgtttgccatcatgcgctggagcgcaatggcgatacagcccattgcgagacatgcgctaaggatttctcgttacaggcactttgtcctgactgccgccagccgttacaggttttgaaagcctgcggcgcagtggactatttttgccagaacggtcatggtttaatttcaaaaaaacgggttaatttcgtcatttccgatcaataaaaccactgtcgacgttgcgtcgcagagcagaggcgccgacgtcttatccggctaagggcaaaagcgttattctatactcccgtaatatcagcatagtaccctgcccggcggttattttattctttttatcgattcaactatttatagggaatattattcccgaaaattaatattagaaataaataacagctttccttttatttattatatcaatattataagtctgtttcatattaaacttttctttttaggaatatatttaggcctgttagttatgattccctatgaatcatccatataatatcgtctcatagcagcgtgtttatttaacaacagggatatcatatggtgcgaaggattcgcattctggttttgctattagtgtctggagtatcagttgcggcttccggcgcaggtaactctgtacctgcaaacgatgaaagccactcctccctgcctgatttagccagcgaatccgcgaaaaaagaagaacaggaaaataaaggaaagtcctttaaagaacagggcgctgactactttattaattccgccacccagggctttgataatctcaccccggaagcgctggaatcctaggcgcgtagctatttgcaaaaccaaatcacttcatcagcacagtcatatcttgaaggcgtaatgtcaccttatggcaagatccgtaccagcctctccgtaggcgaaggcggcgatctggacggcagttcgctggattatttcgttccctggtatgataacgaaaaaaccttactttttagccaactctcagcccaacgtaaagaagaccgcactattggtaactttgggcttggcgtgcgccagaacgtcggcaactggctgcttggcggcaacgcattctatgactacgattttacgcgcggtcaccgtcgactaggtctgggaaccgaagcctggacggattacctgaaattctccggcaactattaccatcctctttctgactggaaggattccgaagatttcgacttttatgaagaacgacccgcgcgcggttgggatatccgcatggaaagctggctgcccttttatccgcagcttggcgctaaattagtttacgaacagtactacggcgatgaagtggcgctgtttggcaccgataatctgcaaaaagatcctcatgccgttaccttggggctggaatatacgccggtaccgctggttacggttggttcggattacaaagccggtactggcgataataacgattttagcgttaaagcgactgtgaactaccagataggaacgccgctggcggcgcaactcgatccggaaaacgttaaaatccagcactctttaatgggcagccgcaccgattttgtcgatcgtaacaatttcatcattctcgaataccgcgagaaagatccgctggacgtcacgttgtggctgaaggccgacgccaccaacgaacacccggaatgcgtgattgaagatacgcctgaggccgcggtggggctggagaaatgtaagtggacggtcaacgcgctgattaaccatcattacaaaattatttctgcttcctggcaggcgaaaaacaacgccgcccgtactctggtgatgccggtggtaaaagcggatgcgctgaccgaaggcaacaataacagctggaatctggtgcttcctgcctgggttaacgccgataccgaggcgcagcgcaccgccctgaacacctggaaagtacgcatgacgctggaagacgaaaagggcaataagcagaactccggcgtggtggaaatcaccgtccagcaggatcgcaaaattgagctgatcgtcgacaacattgccgataacgatcgcagcgatcacagccatgaagccagcgcgctggccgatggcgaagacggcgtggtgatggatctcctgatcaccgactcctttggcgactccacggatcgcaatggtaacgaactggtggacgatgctatgacgcccgtgttgtacgacagcaatgataaaaaagtcacgctggcccagacgccctgcaccacggaaaccccctgcgtgtttattgccagccgtgacaaagaagcggggacggtgacgctttccagcaccctgccgggcactttccgctggaaggcgaaagaagacgcctatggcgacagtaactacgttgatgtcacttttatcggcgacaacctgagcgcgctgaatgcggtgatttatcaggtcaaagccgccaaccctgtcaacctgatcggcaaagaagataaacatcctacggttaataacacctaccgtttcctgctgtggcgcgacaagaataaagacggcgtattccagatgtccgagcagctcacggaagaagagatggccctgtacgactaccagtgggagtttaccggacagagtacaaacggacataccggcgcgctggccaacaccataaatgaagatcttgttctgccagtaaccaataaagaggcggcgcagaagtttgccgccaatgtggaagatggcgttcagggttacggtatacgcgttacgtatagtcagaaatagcgtcagcgttatggctgaccagccagccgctgaattttgagaaaaaagagagtctgaatgcaagcaacagtaaaacggcggctgacgaaggtcgctttagcattagtagttgccgggtattgcgccgcgccagcggtggcggcaaacggtaatctgaaatcggggcagtggcagattgtctctgaacagacgggcaccattcagggtacggtgccgtggattacccgtgcggcggataagaccgcggataccgacaaagatcacgtaacggtaactatcgatcgcggcgatcgtaaaattgtgaccgaaggcgataagcagttccacgttggcgataaggtcacggtcaactgggcgattggcgatacggaaggcgacctggatgtcgacaacgccgccacgaaactgacggtgcagtggatgagatacagcgaccagaatggtagcaatcccgaagagattggcgccaaaggcagcgatacctatgaaattcaggcgggtgacgcagaccattatatcggtatcaaaatcacgccaaccaccaccaccggtgaccctgccgtggcaaccgaactgctgttgaaagacctgtcgaccgatgcgggcggtggtgcggatggcgacgacattccggaaggtccggtggtggatgaaaacgtccatgtggttattcatgagaaagattcgaataccaacctgttgaagaattcagggacgacactcaaaacgaatactacctatcaggtattgctgtggagcgataagaacggcaacggcacctatgatgccggtgaaaacgttaccgaccagtatgactaccgctggaaattcgtcggcaccagtaaaattgcaggtaccggtactggtggtatcgtcaacgaaaactggaacgataaagaccttgtcatcccgcttaccaacgccgaagcgaaagaggcgttcgagggtgcggaaggcggcgttaccgtgggtagcgacggtgtccagggctttggtctgtccatcgactacaaacgcaaataagttgtcctcaacataccactccccgcggggagtggtattttccgcgcactttgcttagccgcgcgctaagcaaagtgggttgaattacgacagagaatgaaaacgggtggctatcgctcatggacaggaatcggcaagtgaataaagttgtacatttcttactgacattactgatcatgtttgtagcgtcgatcgcgcctgcgcaggccttactgaaaggcgggacctggcaagaattgaactcagccactgccgcagttaacggcaccgtgccccgcgccgacggcgcgattattcccgtgtatcagggaagtatgctgcttgacccgaccaaaacctacgatgttgcgtttaccgccatgccgcgcgattttagcgcggatgccacctcaacctcgatgcgtgcggtcaattccaccgataccgaaggcgatctctttagcgatccgccgaccattgcctgggaaaatcaacagccgccgagcgtgggcctgttatgggccgatgccgccacgcccgacacgccgctttcgccgcagccgacgcctaaccagaccttttgcgcccagaacctggccggacggaaactggttgtctggccgcagccagacgatgaaacgaccgtccccgcgctgtggctctatactcacaccggcgtgccgaataatgcggccatcccgctgctcagcccgaaagtgactgtcaatattgcccaggcagtaggcaatcccgtgtcggtcagcggcgatcatgttgatgccagctttaaagcctcaaaagtgaaagtaggagagagcatcaccctcaccgtcacgaccagagggtgtgatggcaaactggtgaaaaatgcgccgtttgtcatccgccgtgaggatgccaaaaaccgtcagggtgtggtcaataacactaacccggtgcacgttggcgatgccgagctaacgaccgtgcaaacggagtatcgcggcgtcaccgatgccgagggtaaagccactgtggtggtgacgcaggatgaaggccccggcgtaaaaacgcatcttatcgtcgcttcgcaaagttatcctacgctgacggacggcgtggacgttattttcaccaccatcaccagccccgacaccgcccaggccaacatgtacggccacatgctggagagcgccagcgccacgctgaacggcgcgacctacactttcactcgaccgaagctggcggtggaggcgggtaacgctgacgaaagcgtcaacgatactaacgaaacctgggcgcagtttacctggagcggcgcggataaccattgcgacgttctgccggacgccgaacaactggtggcgctaagacatgcgcatagtacgctggcaacgtacaccggctggccggcgtcgggcgatgcggaatactggtcgtcaaccaaagatcagatgaacaactaccacgctgccgtgcatatgaacagcgcgtcggtcgtcagagcgcccaacagcgatacgctgctggttagctgtgtggataaagcccagcctgcggcgcacccgcagattaccctctctccggaggggccttataaggcgcaggtgggggaatcgattgatctggtcatgacggtagtcgataaagacacgcaaaaaccgctgccttaccgttacatggagctgtttatcgacccggcgaaaaaccgcaaaggggagcatcaggacgcgtgggataaccagcgggttaccgtcagctccgaagatatgcgcgcctcttcgccggaacactataccggcgtgaccgacgtcaacggtcaggcgcacctgacgctacagcacgacagcggcatggggggcgagacgcccatccgcatcgtgatgccggacgatgaaggcggcaacgtcgagctgccctttagcgtcattttcaccgtaataaccagcccggatgtggacggcgccaacatgtggggccatatgcgcggcgtggtggatgccggcaacctgtataaacgcccgctgctggcggtggaagccagccataaagacggtcagttcagcgaaaacaacgaagagtgggcgacgtttaactccgtggcgtcggccaccgcgcagtgcggcgtcggccaggtgccggatcagtcatcgctggcgcatttatacagcgagcaccccagcggcaagatggaaatcgaacacggctggccgaccgaagactacttcatcgccgcggatagcgacgcctcgggaacggtacacgtcaacctggcaaacggcgacagcaacaaatttaccaatcagccgaactacctgacctgctcggccaatgaaatggtggcggtgctggacgtctacttcaacgacgacccaacgactaaaaatgctgatatgaccgccaaagtcggcgaacagattaagctgaatattcattcgcgcaacgcccttaacgacatggcgattgcctataccgacttcaccatcaccatggcgaacggcaagcggcgcgacggattgacgaccggctttaccgatcccagcaacggcgagatgcagtttgacggcgtgggctaccttgccgggcaggtttatcacgggatcaccgacgccaacggcgatgcgaccattatcctcacccagaataagggcgtggggctactgacgccgttaagcatcgcgcccgtcgattcattaatcaagacgccgatttcccgcagcgtcaagtttaccgtcgccaccagcccggacacggtaaaagccaaaatgtggggccacatggccgacactcttaccgtcggcgactggacttttgagcggcctaagcttgcgagtgaagtaaatagcccgctgcgtactcaggaagagagcaatgaaacctggacgcgcgtggcccatatcgacgcggcgggcaacccggatgcgggcggctgcgcggcgaaccgcctgccgcgtatcgaccagcttgaggcgttatacagcgccaacagcggcggcgcgatgaaaaagactcagggctggccaaccttaattaactactggtcgtccacctaccagagcgccaccacctggaaactgatcgcgctggcgagcggcagtgaatttccgggcagcaacacctcggtttacaccagttgtctggccagcgataacccggtgccagccgccatcaccattgaaccggtcgatccgtcgcagtggtacgacggcagtggcgtccatgcgctgaaagtgaaaaagggcgataccctacagttgaaggtgacggtgaaggacgccagcggcaaaccggtgccggaagcgccgtttgtgctcacccgcggcgacggctacgatcgcaaaggggaaaagtacaccgcccaggacggctccgatttgcaaaatatcgtgacgcccgtggtgatcgacggcgaatcgctggcctggactaccaccaaaatggggtcgcagaccggccctgatggcacccgcatcatcagcgtcacccgcccggacacccacggcacccgcacggccattaccgccacgctgtatgaaaatgtcgccgtgagcgccagcatcgacaccatctttaccgtcgtcaccagcccggatgtcagcgtcgcccgcatgtgggggcatatgacgccgtcgctgacggctgcggatagcgcggtgtacaagcgcccgctgctctacgatgaactggccagcaagaccggtgctgcggagtacccggaagacaacgaacgctgggtggtgttctatgggccgaatacgaccaaaaccgttagtccggaagcttgctccaaggggtatttcccgtccgttgagcaactggattctctgtacagcaaatacccgaacggagcgataaaaaccgcccagggctggccgatcatccgttcttactggagcggcacaaacgccgggacaatcacccccggcgcgccaccctatgactattacacggtcgatctgaatgatgatgcgcaccggaaggttcccaatattagtgatagcgacaggcaataccagatttgcgccgcgacgccgcagcctctggccgggcggattaccctcacttctacgctggcgacggatagcgatatccaggcggtgaaggcaaaaaacagcgactcgattccgctggtgatcaccaccaccgatgcggcgggcaacccggtgccttatacgccattttccctcatacgcgacgccgggacggcgcgcaacaccagctatacctttaccggcagcactaacatgatgctggcgccgcccaccggttcggcgcaacagttctactataatggctacactatttacggtgccaccggcgcggacggcacggcggtcctcacgctgacgcaggccgcagggccgggggtgaaaaacgtgataaccgcagccctgaccgacacgccgacggtaacctcgacgctgccggtggtgttcaccaccgtgaccagcccggacagcccgcaggccaatatgtatggccatatgccggaaaccttcaccgccagcaacggcgcggagtttaagcgcccgctgctgtatagcgagctggcgtcgacgttaggtgtgaagagctatgccgacacaaatgaaaactggcctatagtgaataattttgataccagtaattatggcgcctgttcgataaatcagatggccacgctggatgatctcaaggcgctgtacggcgatcaccccagcggcaaggtcacgaccgacataggcttacccgtcaggaagaaatggtgggcgggcgacagcctgctgcaaggtcaagtcatatactggcgatatatcgatctcagtacgggcatagattactccatgtcgggaacgccgggtaattactattaccagctctgcctgaccaaaccgcgccagatgaatatcgcgctctctacggacgcctggaacgcggacaaatcggcggccgtggcgaaaaaaggcgaaacgatccccatgacggtgaaggtgacgaacgctgccgggcagcctgttagcaacgcgacggtgaaaatcacgcgcggcgatgcgctgacgcgtgcggggagcgtgtataccaccaacaacgcggacgatattaccttaagtaatatccagccttccggtacggcgacgtacttgctggggtcggtggataaatatatgtatgcgcaaacggacgcccaggggcaaataacgtttagcgtgtcgcaaaataatactatgggtcttaaaacgcccatccgcgtcaccgttgcgaatgacattaccgcaacgagcagtaaggacgtgatatttaccgtccttaccagcccggacgtcgccagcgccaactactgggggcatatgccggaaaccgtggaagggccggacggcctccgctaccagcgcccgcatttgcaggcggaagcgccgtcgggcgtcaactacatcaccgtgaacggtgaaaaatgggcggcgccgaccggcgtacagacgtatacggcaggccagtctgcgtgcgacgttgagtatatgccgctgatgaatgacttaaaggcgctacagcaactgtatcctgacggcgcgctggaggatcaattcggctggccggtgaaaaccggtaaactctggtggtctgccgatctgaatagctcgaaagcacaccaggcgataaacctgaaaaccggtcagatatcggcgccaacctccaccagcttgcaggcctgtttggtcaatgcgcgtaatgtccctgcctccattacgctaacctcgacggcgatggatgcggagaaaggcgcggcggtggcgaaaaaaggcgaggctattcccttgacggtgacggtgaaaaaccgcgcgggcgttcccatagcgaatgaaccgtttaccctgaaacggggcgatgcgaatgatcgcctcgacattaaatatacgtggaatactacagcagacgatttgacgttgcaggaactgacgccgtcgccgacaacgaaatcaatgacggcttccggcaatgtgtttagcggcgtcacgggggctgacgggacggcaacgtttacggtgaaccaggacggcagtgtggggctaaaaaccgagctgacggccagcgcgacgggggatgtcacgcaatcaaccaacacagcgctgggcgtgatctttaacgtgattaccagcccggataccgataaagcgcagtactgggggcatatgccggatacgctgacggttggtggcgtgacgctgcatcgccccttgttgatgaaagaagcgcctgctggcgcgacggatagccggaaagaaaataacgaaacctgggtttcggtttatacgaaagccgatggtcttacctatgatatgagcaagaactgtggcggggtggccgggttcccggcaaaaggcgtgctggaaaaaatacgcgatgagcagatggcggtcgctaacggatggccgacagtttcgttgccttacgctagcagtacgcctgggacgtataattattgctgggtttcgttagcgaaagggggcacaacacattgcccgaccaccagcagcgattactcgataggctatgccgcctgtcttgtacagccgtgatcgggatggttgggtttcggtaaattgtcgttggtaccggtagtgaaacgtttcgcatttttaccgccgatggaatgaatagtcagaaagggatgtattccaggtgctgcattgaaactgaaaacgaatacccatcttttatccgggctacaggcatgtctgttttgtgttaccgctttttttgcccaggcggcgcaaagcagcgccccatggcaggagcctgacgtctcaactgccgccattaacggcacgccgccgctggctgacggcgtgacgatcccggtttatcagggcagcgttcagttgcgatctgatgcagcgaatcccgtcgattattccgcgaaacccagccagttcagcaccagtgatgtcggcagcgcgctgaccttaaccaatccgcgcgatgccgaaggcgatattttcgccgagccgccgctggtctggcagagtgaacggataccctccgtcacgctggtatgggccgacgccgccacgccggagacgccgctgtctccacaatcgtcggcaaacctgacgttctgtgagcaaaatatggcaggccgccatctggtagtctggtcgcaactggatacctcaaccgctatgccgccgctgtggttgcttacccgcaccggcgtgccttataacacggcggtcgaagtgcttgaacaaaagtttgccgtggatatcgcgcccgccgtgggtgacccggtaacccttaccgccgatcatctggatgagtcgcttaacgccgcgaaggtgaaagcgggcgaaagcatcacgctgacggtgaataccaaaggttgtaacggtgagccagcgggcaatatcgcgtttgtgattacccgcggcgatgcgcaaaaccgccagggcgtggtgaacaataccgcgccggtacgcgtcggcaacaccgaactcaccaccactgccaccgaataccacggcacgaccaacgcggaaggggtggcgacggtgaccgtcacccaggctaacgggccgggcgttaaaaccccgctgatggcgcacccgtcgaacgcgcctgcgctgaaagccagcgcggatgtgatttttaccaccctcaccagcccggacagcagcagcgccaacatgtacggccatatggcggacagttccaccgccacggtggacggcgcaagctacacttttgaccgccccaaactggcggcggaaaccgagggcgaagaccgcgtcgccagtatcaataatgaaaactgggcgcagttcacctggggccatgcggataaacactgcgatattctgccggatgcgcgccaactggaagggttaaaaatcgagcgcggcgatttagccaccactctcggctggccggtggggtgacatccggtgacgaagagcactggtcctcctcacagggggcgagcgcaactgaccacatcagcattgatatgcgcagccgcgcccttacgcagatgccggacgccacgcaatcgctggtgagctgtgtggataaagcctcgcctgcggtcacgccgaaattagtgattagcaccgataattttgattcgacggccaacgcggcgaaagtgaaggtgggcgaagagatcaacatgaagatcgccgtcaccgacagcgccaccaataaaccgctgccttatcgctactttaatgtctacctgggcgacgagcaaaatcgccagaatcagaagaacgccgatcttgatgccgcgcatcagtggacggatgaaccggtagttatcgccaatctggacggcggcgacggtcactatcacggcgtcaccgacgccaacggccagttttcgctggcgctgacccaggacaagggcgctggcgtattaaccccggtgcgcgtggtgctgttcgacggcacggaagcgacgcagaatgtgatttttaccgtcgtcaccagcccggacgtgacgcaggcccgtatgtggggccatatgcagggcgtggtggaagcgggcaatatttacaaacgtccgctgctggcggaagaggccgcgcaggataccggttccgaatttgagaataacgagtactgggccacgtttaactcagtgacggcagcgacaaaccagtgcggcgcaggccaggtgccgggacaactgctgctggatacgctgtatgaagcccattccggcaatacgatggaaacgacttacggctggccgacacagaaacatagctatattgcggcggataccgatggttccaccactgcgcacgttaacctggcgaccggcgcggacagcctgttcagcggcgctgaaccgaactatctctcctgctccggtaacgagttggtgaccagcctggacgtgtactttgatggcaacgagtcgttacgtaatgcggtagccaaagtgggcgaaaaaattacgatgaacgtccattccgtcaacgcgctgaacgggttaagcgtgcccaacgccagctttaccgtcaccatgtcgcacggtaaaaatcgcgccaacgccaccacgggctttaccgatcccagcgacggaacgctggtgatgggcggaacgtctttcggctcttccctggcgtcgatgacgtaccagggcatgaccgatgccgcaggcaacgccacgctggtcattgaacaaccgcagggtgtcggcttgctgacgccgctgaccgtactgccggttaactcgctgatcaccacccccgttaaccgcagcgtgaagtttaccgttcccaccagccccgatacgccggatgcgcaaatgtggggccatatgtccgacgccatcacggtgggcgatatgacctttgagcgaccgaaactggcggcggaggttgccgcgacccgcacccaaaccgaggccaacgagagctgggcgcgcgctacccatgccgatgcggtaggcaatacggcggcgggcggctgcgccgctaaccgattgccgcgcgccgatcaactggaggcgctttacgccgctaaccgcgacggggctatcaatagcacgcacggctggccggtgctgattaattactggacctccacctggcaaagcgccacaacgtggaaactgatagcgctttctaacggtagcgaatttccgggcggcgctggcgcatccgattacgtcagttgccttgccagcgataacccgacggcagcctccatcaccattgagccggtgaatacgtcattgtggtatgacgagaacagcgaacacgcggtgaaggtgaaaaagggagatacgctccagcttaaagtgacggtaaaagacgccagcggcaatccgctgccgcaagcgccgttcgtgctcagccgcggcgacggcatcgtctcggcggtagtgattgacggcgattcgctcaacgacaccgccaccaaaatcggcggcatgaccggtgaaaacggcagcaaaatcatcaacgtcacccgcccggatgcccacgggacgaaagtcgcgattacggcggcgctgtacgataacgccagcgcgacggccagcatcgacactatttttactgtggtcaccagccctaatagcgacaaagccaaaatgtggggccatatgccggaaacgaccacggcggccaacggcgtggtgtttaagcgcccgctgttatcggctgaaatcgccagcggctttacccacggcgacaatacggaaaacaacgaagcctggggaatcgtcgattttgaagtggcgaacgacgcctgtggcgcgggatacgtaccgacacttgccgatctgcaatcgctgtacgacgccaggcccggcggcaccatgaatacgcagcagggctggccgctggatggtaaaaactaccagaacagcaccgctgatttgagcaggagtacggaaaaccgctacgttaagtcgattgatctgcgcgatggcggtattagctcgctggcgtggagtgaacaactctatttcgtctgcttgcaaaacgcccatccggcggcgacgcagataacgctcacttcgcctttgtataacgacagcgacggatttgccaaagcgaaagtcggcgagaccatcccggtcatcatcaccacgcgggacgcccagggcaacctggccgccgacacgccggttatctttacgcgcggcgacagcgtcgggcgcgcgaatcaggaagtgaatagcgcgtcggcggcggagatacagataaaccacagcgacgggcgtagcagcggcgttaaatattacaccgccaccggcgctgacggcacgctgacgctgaatatcagccaggacagcggcgcgggctttaaaacgccgctgacggcggtgatagagcacaacggcgtaacgagcgcgctgctaccggtcatttttaccgtcgtcaccagcccggacacgccgaaagccaactactggggccatatggcggaaacgctgaccgacagcagcggcgtggtgtacaagcgcccgttgctggccagcgagttcagcgtcacgcccggcaaatcgctgaccatcgccaacggttactacgacaaaggcgaaacctggggcatgataaccgtcgataaagcctagaacggcgccggcggcggctgcgggcgcaattatctgcccaccgtcagcaacctccagacgctgtacagtacctggcctgataacgccatgcgcagttgtaacggctggccgatgaccagttctggcaacaataacgtcagccgctactggtgggcgggggattacgtgatgtcgtcagacggcgcgcagtcgctctacgcggcggtcaacctgtttaacgacggcaatgatgtcaaaacgacgaccagcaccacgacgtactatatgcagacctgccttacctcgccacgcagcgccgccgccagcctgacgctgacgctggcaggccaggatgcagccaccgggatcgcaaaagcgaaaaagggcgagcagatggccgccaccgtcacggtgaaagacgccgcaggtcagccgatgaaaaacgtgatggtgaaaatcagccggggatcttcgtacaaccgcgtcaacagcgccacatcgtcctcaagcgctgcagacgatattacgctgcgtaatgtgatgccgtccggcccggcgacatacctgctggatacctccgcgaaatatctgtatgcgcaaaccgatgcccagggacaggtgacatttacccttgcgcaggacagtaccgcaggtttaaagaccaccatcagcgccgccacgatggacggcagcaacctgacagacagcaaagacgctatctttaccgttatcaccagcccggatagcgacaaggcctcatactggggccatatgccggaaacctttaccaacagtaagggcgttgagtttgcgcggccgctgctgcgcgccgagctttcttcaacgacggataccacgtccttcctgtcaaataatgagcactggtacacctggaaccgctatccaaacctgtatcaggactccgccagcccgtgcgatcggctgggattgccgacgctggatgatttaaaaacgttgtataacgactatccgaatggtggactaacggccgcctttgggttgcctgtagacgcggggaaatactggggagcaggggattcgaaagtcaacgatacgcactcgacgaataatttccagtatatcaggctaaataacggcgttacgcaggtcacaaatacgaatacctcaacggcgcagctctgtctggcgaagcgcagggtgttggcgatagcgttgacctccagcgccatgaatgccgaaaaatccgccgcgctggcgaaaaaaggggataaaatcccgctgacggtgaccgtcacggacggcgccggcacgccgtagcccaatgtgcccattcggctggggcgaggaaactattcgcaaaaccgggctggcggtagtgacagcaccaacaacagcgacatgctgttaacgccgattgcgccgccagcggatgctaaagtatttgcctaccattattccggggagcagctctggtactggtacggcactacggatgagagcggcagggtgcagtttgagctgacgcaggataatacccccggcctgaaaacagcgctgcaggcgatgctgtccgacaatccgccgaccgtcagcaatatggatgtcatttttaccgtcattaccagcccggacagcgataaagccaaaatgtggggccatatgccggaaacggcggccaacagcgcgggggtgaaattccaccgcccgctgctggctgcggagatgacgtcgaatagcggcacctactattacaataacgaaacatggcctctggtgactatcgcgaacacccagaaagcgggcgcgaccacctgtgatgctgcatatcagccgttgtttaatgacctgcaaacgctgtatagcgaccatccagacagcgctctcaatacggcattcggctggccggtaggggcgggtaaaagctggctggcggtggaccaggagcctggaaccgggtattaccagtatctgcggctggataccggcgccaaaggccacaccagttccacgagcgtgtctggcgcgcaggtgtgtctggtcgagccgcatacgtctactcctgccaatattacgctgacctcgacggcgatggacagcgcgaaaaacgcggcggtagtggagaagggaagcgcgatgccgttaacggtgacggtaaaagatagcagcggtaacccggtcgccaacgtcggttttacgttgtcacgtggcgattcgaaaaatcgggcaggtacggtggtaacggatggcgacgtggcagcggatgccggagcagatgatctcatgcttaaagagctgactcccgcaagcgccagccgaagtatgaccaccaccgggattgtctttaccggcactaccggcagcgacggtacggcaacgtttacgcttaatcaggataaaagtctggggttaaaaacgccactcacggtgaaactgacggacaatacggctcttcacgcctcactggatgtgatttttatggtacttaccagcccggatacggataaagcgttgttctggggaaatatgtcggatacgacatccgtcaacggaaaaacgctgcatcgtccgtggctgcaggctgagctaccgtcaggcgtgacgccagtatttaccaacggagttcatgcaaataacgagtactgggcgatgacgcatacggtggacaacactaaatgggatattgctaaacagtgcggtagcctgagcaaagcaccggataataacgacctgttgacgctgtatcattcaattagctcgttaggctggccgacgctgggctatccctatttatctaaatcaacctcgggcggcggcatgtattgcggcgtggatgagaatactaagcagcaaaactgcgccattcagccggcaagtacagcaggttatgcgacgtgcgtggagtaacgtattaagcgtctggcacgaaaaataatttgtttttcacgttcaattgagcttcatgaaaaagtgatcggagcattcattgaaaagtatatgttctgctaattggagtcatcaccgtttgccgctggtgtgtagatgcgccgtttcccttctgtaacccggtatctggcgctacctatatacaaaataacaccaggtgtcgcatgataatcacaccttttatctcacgtatctatttatctcaatatatgaaattattaaatgttattcataatataaatatttattaaatagataaatatattcatattaattataaattaaccagaagctgacctggtattgaaataaggcttgaaattagttaataatttgtctttgataatacattgttacagatgacagcaaccattcatagaatcatatttttgttatttattatttaactcatttatatacaccatttaaaagctatttgcagccaatcaaatcaagtttgcttcgtgaatgttattaaaaggaaatttaaaaattgaacaggacctacagtatcgtctggagcgccgtgcgaaatatgtatgtcgtagcttcagaactggcgcgaagccacagcaaagttaaaatacaggcgcacgctaatgaagtcgccccttctattaaaaagcctgattcaggatgggcaagacaccatgcgctggccctggcaattgttgccgcgcttggctttgccagcccgctggccatcgccgataatccggtgtcatacaccgatggggtcaagcacgacctgagcgacgattcgccgatttcctactcaggcactggtgaaggttctgcactgcacctcgaaggccttgcaacgcccgaagggggctggcaggcaacgtcgggtacaggtacaaatgtcgtgattaacaccaacggcggcggcgatcctgttcagggaactcatgctatcgccacggcagttaccctcaacaagggcgcaacacttgacctgaccggggcgcagatctctacggaaggaacctacacggcaggtatcgacctccaggcgcaaagcagcatgacgctgaatggcgggagcatccagatcggaagtaattacggcatcctgaccctctctggcgagtcatgggctgccctgattggcaccgacgttacggcaacgacgcaaagccgtagcagcatagtgtcacaatcaggtagcacgcttaacattaaggacgggagcgtaattacgctgacaaacggccaggtgcgcgtagtaggcgagacgacatacaactcctggctgaatgtgtccgatagcacgatgagctccacgggtacggatagtacgcttcttgtgtccaacaagggcgttcttgatattacgaactctaccgtcacgcacgataatgccacaggcgccgctattgaggtgaaaaacgcctcaacggtgagcatctctgatgataaagattcgatggccatcaactccaaaggcatcggtattaaaatcctcgcctccagcgtggatattaacggcgccaccatcaacgccgacggcgacggcatctttataacaagcaaaggtaaaagcggtgggtatgatgatatcaacgcgctgacggttaacaaagcacaggttaattcagagacgattgcgctgcatgtggactctggcacgacgattaacgatcctatcgtgctaaccgatagcgcatttgacgcgccggcagtgatcaagctgggcagcaaggcggtcattcaggccgacaatacgacattgaacggtgacgttgttcagagtgacatgtcatcgtcatcgctgtctttaagccagggttccacgttaaccggtagtgtagatgcgatgtttactacactgtcgctcgacgatactagccagtggaatatgaccgactcgtcaatcatcggcaacctgaccaacaacggcgacattacgctgaacaacgagagcggttcgacaggcacgctgctgacggtgggcaataccctgaccttgcaggacggcagccagataaacgcgacgctggataccgccaacagctcgccaattatcaaagccgccaacgtgacgctggatgggacactgaaccttagctcagcggccacctttgtcgcgcccgaaaccgacgagcagttaggatcgttcacgctaattgattcgcaaaccgcgattactaccgattttgacagcgtaacgctggatgccgacacctctgctatgccggattacctgacgatcaacgcgggcgttgatgcgaatgataataccaactacgtgttgtctacgggcctgagctggtacgcggacgcaaaatctgcgcgcgttgcgcacggcacctttaccgttgacgcaggcgatacctttaccgtcaccagcgaactggatgaaaccgcggccacctccaactgggacggtaaaacgctgttcaaagaaggcgacggtacgctcgtcctcagcaacacggcgaacgacttcggcaataccgacattaacggcggtacgctgtctgcgaatgatgccgccgcgctcggcagcggcgacgtggccattgcagaaaacgcaaagcttgagttgagccaaggcacgctggataacaacgtgaccggcgagggccaaattgtcaaaagcggtagcgatgagctgatcgtgaccggcgataacaactacagcggcggtaccactatttccgacggcacgctgattgctgaccatgcagattcgctgggtaccggggctgttgccaacagcggcgtgcttcaggtcggcgaaggcgagctggaaaatacgctttccggcaacggttcgctgatgaaaaccggtacgggcgagctgacgttaagcggcgacaacacttactccggcggcaccactatttccggcggtacgctgattgccgccaacgttaacgcgctgggcggcggtgatgtcgataacgcgagtacgctgaagctggacgcggagggcgaattcaaccttgcgaatgtcacgacccagtctggagcaacgactgagctgtccaaaggtacgacgctcaacgtcgactcgctgactcagcaagccgatagtacgctgaatattgacctcagtaagactaatggtgaaagcgccattaccgctgacagcgtctcgttggctggtgcgctcaacattaccgggatcggcaacgtcacagacagctggacgcctgaggcatacacctacacgctgattgacagcgacagcgccattacgaccgatttcaatgatttgaccgtcgcgggaatgaatagcgaagatgttgacttcctgaccatcgacggaaaagtcgacgaagcagatagcacaaactatgatctgacggcctccctctcctggtatgcggacagagacaacgcttctaccgacgcccacggcacctttacgctaagtgaccctgacggcagctttaacgttgcggctaaactgacagatgttgatgacgcgctggatccgggcagcacatgggacggtaagtcgctgaccaaagaaggcgcaggcacgctgatcctctccggcgacaacgactacagcggcggcactacaatcaatgaaggtacgctggtcgccgccagcacgacggcgctgggcaccggtctggtggacaataacgccacgctggtactggacgcagacggtgaagtcagcgcggtgggcggcatcaccactcatggcggcgcgacgacccaactggcgctcggcacctcgttggatctcggcgacagcgcgttaattcaggaagatggcagtacgctgaacgttgagctgaatagtgactcagcgcaaccgctgattaccggtggcagcgccacgcttggcggtgatttggtcgtcagcgacgccagcctacaagcgcgcgcctccgacgcggagttccagtcctttaaactgatggatatggacagcgatatcagcggcgactttaccagcctgacgatgaacctcaccgacaagccggactatctgaccgtaaccggaacaatcaatcctcaagaccagtctgaatacctgcttaccgaagggctgagctggaatgcgaccgccacgtcagcgacgccagcacacggcaccttcactctgggcgcaggcgatagctttgaagtcaccagcgtactgggcgataaaaccggcaacggcggctcgctttacctgaataccgtcctgggcgacgatgattcggcgaccgataagttggtcattaccggcgatgcctccggcaccaccgatctgtacatcaacggcatcggcgatggggcgcagaccactaacggtatcgaagtggtggatgttggcggcgtatcgaccagcgatgcgtttgtgttaaaaaatgaggtaaacgccagtctgtatacctaccgtctgtactggaatgaaagtgacaacgactggtatctggcgtcaaaagcacagtctgatgatgacgacagcggtggcgatgtcacgccttcggacgacggcggcgacggtggcgatgtcacgcctccggacgacggcggcgatgtcgcaccacagtaccgtgcggatatcggcgcgtacatgggcaaccagtggatggcgcgcaacctgcaaatgcagacagaccctctatgaccgcgagggcagccagtatcgtaacgctgatggcagcgtctgggcacgcttcaaagcgggtaaagcggaatcagaggctgtcagcggtaatatcgatatggacagcaactactctcagttccagctaggcggcgacattctggcttggggtaacggccaacagagcattaccgttggcgtcatagcgagctacatcaacgccgataccgacagcaccggtaaccgtggcgcagacggtagccagttcaccagcagcgccaacgtagacggctacaaccttggcgtctatgccacctggtttgccgatgcccaaacgcatagcggcgcgtatgtcgacagctggtaccaatatggtttctacaacaacagcgtagagagcggtgatgcgggatctgaatcttatgattcaaccgctaatgctgtctcgctggaaaccggttatcgctacgatattgcgcttagcaacggtaatactgtcagtctgacgccgcaggcgcaggttgtctggcagaactactcagcggatagcgtgaaggataactacggcacccggatcgacggtcaggatggcgacagttggacaacgcgcctgggtctgcgtgttgacggcaagctgtacaaaggcagccgtacggttatccagccgtttgctgaagccaactggctgcacaccagcgatgatgtgtcggtatcgtttgatgatgccacggtgaaacaggatcttccggctaaccgtgcggagctgaaagtgggtctgcaggcagatatcgataagcagtggagcgttcgcgctcaggttgccgggcagactggcagcaatgactttggcgatctgaacggtagcctcaatctgcgctataactggtaagttagacaaaaccgggcgggtattccctgcccggttttgaggcgaatgacaaaccggttgagcgtcggattgtggctacaccttatccgacgtggcgcgtgggttggctgaggtgaagtcgaaacccaacatcgcgctgcaaaaggtgggggagtgttggattacgttcccggcgtgacggatttgacttcactttcaagccagccgtcctccagccgcgtggtcatgatatcgcctgctttgacctgtttgatctttttcaacaccttgccgtccgttgtcgtcgaaaccgtatagccgcgcgccagcgtggctaacgggctgaccgcttccagatgcgtgaccgcgttgccaaaacgctcgcgctgttcgcttaaccgtgagcggatattctccgtcagacgatattccagctgttggatgcgcgactgcacgcggtgaatgcgcggctgcggattttgctggctcaggcgttgacttacgcgttgctgacgctgagtggcctgcttaatcctggcctcaagcgcaaatcccatccgttggcgtagacgttccagcgcggtttgctgacgggccagacgtagttgcggatgttgttgttgcagacggtgaaaaatctgcgtgaaacgacggctgcggttggcgaggtagtagtccatcgccatgcccagacgctgctgggcggactggatctgacgcaacaactcctgctggttacggctgacaatttctgccgctgctgatggcgtcggcgcgcgcaggtcggcgacaaaatcggcgatagtgacgtcggtttcgtgaccgacggcgctgaccaccggaatacggctggcaaaaatagcccgcgccacgcgttcgtcgttaaaactccacaaatcttccagcgaaccgccgccgcgtccgacgatcagcacgtcgcactcgccgcgcgtgtttgccagttcgatagcacgaacgatctgccccggcgcatcgtcgccctgtaccgcggttggatagataataacgggcagggatgggtcacgacgcttcaacacgtggaggatatcgtgcagcgccgcgccggttttcgaggtgatcaccccaacgcagtgggccggggagggcaacggctgtttatgctgctgatcgaacaagccttcggcatggagtttggcttttagctgctcatacttctgctgcaacaagccttcgccagccggctgcatactttcggcgatgatttgataatcgccgcgcggctcgtacagcgtaatgttggcgcgtaccagcacctgctgcccgtgctgcgggcggaacgtcacccggcggttgctgttgcggaacatcgcacagcgcacctgagcggtatcgtctttgagcgtaaagtaccagtggcccgacgcaggctgcgtgaaattagaaatctcgccgctgatccatacctgtcccatctcctgttctaacagcagacgaaccgtctggttaaggcggcttacggtaaaaattgaggaagtttgagaggataacatgtgagcgggatcaaattctaaatcagcaggttattcaatcgatagtaacctgctcacgggggatcgcaagcactatttgcaaaaaaatgtagatgcaaccgattacgttctgtataatgccgcggcaatatttattaacctcccaggtgagatattgcccatgctacgtatcgctaaagaagccctgacgtttgacgacgtcctccttgttcccgctcactccaccgttttgccgaatactgctgatctcagcacgcagttgacgaaaactattcgtctgaatattcctatgctttctgcggcgatggacaccgtgacggaagcgcgcctggcaattgccctggcccaggaaggcggcatcggttttatccacaaaaacatgtctattgagcgccaggcggaagaagttcgccgcgtgaagaaacacgagtccggcgtagtgaccgacccgcagaccgtcctgccaaccaccacgttgcatgaagtgaaagccctgaccgagcgtaacggttttgcgggctatccggtggtgactgaagataacgagctggtgggtatcatcaccggtcgtgacgtgcgttttgtgactgacctgaaccagccggtgagtgtttacatgacgccgaaagagcgtctggtgaccgttcgtgaaggcgaagcccgtgaagtcgtgctggcaaaaatgcacgaaaaacgcgtagaaaaagcgctggtcgttgatgataacttccatctgcttggcatgattaccgtaaaagatttccagaaagcggaacgtaaaccaaactcctgtaaagatgagcagggccgtttacgtgtcggcgcggcggtcggcgcaggcgcgggcaacgaagagcgcgttgacgcgctggtggcggcaggcgttgacgtcctgctgatcgactcttctcacggtcactctgaaggcgtgttgcaacgtatccgtgaaacccgtgctaaatatcctgacctgcaaatcatcggcggcaacgtcgcgacgggcgcaggcgctcgcgcactggcggaagccggttgcagcgcggtgaaagtcggtatcggcccgggttccatctgtaccactcgtatcgtgactggcgtgggcgttccgcagattaccgctgtttctgacgcagttgaagcgctggaaggcaccgggattccggttatcgctgacggcggtatccgtttctccggcgacatcgccaaagccatcgccgcaggcgcgagcgctgtcatggtcggttctatgctggcgggtaccgaagaatccccgggcgaaatcgaactctaccagggccgttcttacaaatcttaccgcggcatgggctcgctgggcgcgatgtccaaaggttcctctgaccgttacttccagagcgacaacgccgccgacaaactggtgccggaaggtatcgaaggccgcgtagcctataaaggtcgcctgaaagagatcattcaccagcagatgggcggcctgcgctcctgtatggggctgaccggttgtgctaccatcgacgaactgcgtactaaagcggagtttgtgcgtatcagcggtgcgggtatccaggaaagccacgttcacgacgtgaccatcaccaaagagtccccgaactaccgtctgggctcctgattttcttcgcccgaccttcgcgtcgggcgatttatttaatctgtttcacttgcctcggaataagcgtcaatgacggaaaacattcataagcatcgcatcctcattctggacttcggttctcagtacactcaactggttgcgcgccgcgtgcgtgagctgggtgtttactgcgaactgtgggcgtgggatgtgacagaagcacaaattcgtgacttcaacccaagcggcattattctttccggcggcccggaaagcaccaccgaagaaaacagcccgcgcgcgccgcagtatgtctttgaagcaggcgtgccggtatttggcgtctgctacgggatgcagaccatggcgatgcagcttggcggtcatgtagaaggttctaatgagcgtgaatttggttacgcgcaggtcgaagtgctgaccgacagcgcgctggttcgcggtattgaagattccctgaccgccgacggcaaaccgctgctggacgtgtggatgagccacggcgataaagtgacggcgattccgtccgacttcgtgaccgtagccagcaccgaaagctgcccgttcgccatcatggctaacgaagaaaaacgcttctacggcgtacagttccacccggaagtgactcacacccgccagggtatgcgcatgctggagcgttttgtgcgtgatatctgccagtgtgaagccctgtggacgccggcgaagatcatcgacgacgccgtggcgcgcattcgcgagcaggtaggcgacgataaagtgatcctcggtctctccggcggcgtggattcttccgtaaccgcaatgctgctgcaccgcgcgatcggtaaaaatctgacctgtgtattcgtcgacaacggcctgctgcgtctcaacgaagccgagcaggtgatggacatgtttggcgaccattttggtctgaacatcgttcacgtaccggcagaagatcgcttcctgtccgcgttggctggcgaaaacgatccggaagcgaagcgtaagatcattggccgtgtttttgtggaagtgttcgacgaagaagcgttgaaactggaagacgtgaaatggctggcgcagggcaccatctaccctgacgtcatcgaatctgcggcgtctgcaaccggtaaagcgcacgtcatcaaatctcaccacaatgttggcggcctgccgaaagagatgaagatggggctggttgaaccgctgaaagagctgttcaaagacgaagtgcgtaagattggtctggagctgggcctgccgtacgacatgctgtaccgtcatccgttcccggggccgggcctcggcgtacgtgtactgggtgaagtgaagaaagagtactgcgacctgctgcgccgtgctgatgccatcttcattgaagagctgcgtaaggcggatctgtacgacaaagtcagccaggcgttcaccgtcttcctgccagtacgctccgttggcgtaatgggcgatggtcgtaagtacgattgggtggtctctctgcgtgctgtcgaaaccatcgactttatgaccgcgcactgggcgcacctgccgtatgacttcctgggtcgtgtttccaaccgcatcatcaatgaagtcaacgggatttcccgtgtggtgtatgacatcagcggtaaaccaccggctaccattgagtgggaataagtcgataacccttcctgtgttttcatgaacaggtaaaagtgaatttaaccctctgtttttgcagagggtttttatttatgtgcatagatgcattttctgtgtagtgcacagcttctggcggcaaagcactgcatcgacacaatagtgggtttcactggcagcacacaatcaaatctgacagtcggcttcgagcgaggtgcggacattggtagcttcaacaacatgactggcattgaggtgtattaatcaacgggaagcaggtcagtttactccgccagcccgacttttacgaaagggctaccatgactacgcgattttttgattagcttgccaacgtataatcctctgatttctggtgatgcgattcgtccaacaaattctgaacggttggtttcgggggggggatgaccaattcccgggtaaagtattgctgagagcctgccttcaaccagcactgtatctcgtaaacttccatcaccaaaccgccgtaggtggcgtatgcaaattgtaggttttcatcttttggtacttttgcccagacgccacgcgtagcttcatataatgcaagtgcactcatgccagacttgtaggtgctgtttagcaaaaaagcgagcccggcatgttcaggtgcgatttccgtctcttgcttaagaagaagatgattgagctcatccagcgtgattcgccccataagggagctgcttcctcgtactttgttggtcagttctccaacacccaagagatcaatacatgttgcttcaacaagcttcgcggttgcctcatccatgccatggcgtagtatgtcgatacccagatttcctgtttttaacagatgattaattcgttctgatttcggagagtcatcattatactttatatgatcaaggcagcgttctgacttgcctttgcctatataaaacggcttcttagctgcatcttcagtgtcataaaatgcataaacatagaacttagccatccctaacgcttttgagtattttgaaaaatctttcaaaccttgcttccttaaggcaaaagtacttaattttactatcggcactatagttcagaacttaagcgcaaaacaattagcgtatagattgacctgcgtccattgatgaatatgggccaaagttaacaacgtccgctattggcacagacctgcctgtcagattaggtttaggtctgtgccatagctatgtcaggtcaaatctgagctaatacacataaatgattagcgaaatcagttaaaccagccgcttgccttttcctcacgggctttaccttcgctttgcagcagatcgcgaccgccttcagatagatttctgtttgcatcagcatgagattgaataacatctgtctgggcagctttacttttcagctcttgatcgatgaattcattttctctttttacccgggcctcttccctggccagcgccagtttttgtttctgaatttctaaacgacgaagctcatcttcgtagctttgatcgcgcgctttatcttgcgcggcttccgctgccaattttgcttgccgtgctttccgttcagcttctgccgcttttgctcgctgcttagcaaccgctgccgcattggcttgcctttgtctttcctgttgagcctcttgatctcgtttggcttgcagagcatcacgctgtctgttttcttcattttttccttgctgttcagcctgggctaccgccgcaagctgatcctgcaaagaagaagataaaaccgagccgcttagagtgaataaaacagcgcctaaaataactttcttcataaaatctcccgatagttagcttttctcaggacatttcgtattgggttgaattcgcgtttcgttatctttggtcgatatcaccatagccagaccggtggtaaattggcacgtttttcccacctgggtggaggtataaaccttcgttccttctttgtaagtcaaagatacggcttcaactaacgttttatctttaaccaatgaccccgccgctgcgccaacggctccgccgccaaccgcgccggcagtagtacccaaaccgctacctgagcccacgttatgaccagtaacgccgcccgctacagccccaagaattgcgccgaaggtctgagcggtttttttattggcggtgttatctacggcaactttcgctggcaaaacagagataatattgacggtctttgtttcttgcttcgcgtttaactgcccggtttggtaaacatctgcggcgtagtcatccgcattggactggcatccggcaagagaaaaagaggcaaacaaaaccagaggcaaagcattttttttttaaattcatcacaattccttgtttaggtaataacgcaaaaaggaatgtatttaagactaatcttaaaaaaagtaaactatcgtttcttgtagttgattgttttttttagactaaaaaacaaagcattagatgatacgatgctttgtttttatcggttcatgctaagccagggaaggggataacagagcgctggataacacggcaaacctgtgacgataataccgccatcactattttaacggataacagcttaacgttgtcccggcgtggtgaccgaaagcgatgactgttgcgcttcttttttatcctgatggtgctgccaggcgccgatagaagagtagacgaaacgtccaaagaagaagagaaaactgataagcagtacgatacgggtcatgcgagtgttaaatcgatgtcgttttcgcatactgttggcctgacttacaaagggttccttaacgttggcccagcggtatgggcgggatcaggctgggttcttcaaaggtattatcaaggcgaagaacgtaacaagcctgcgttcactctacattaaggcatactgcgaaccgatggtcaattcctcttaatgtaaaattgcgtcagttgatttatcttatattgttatggaagataattttagtatttacattaataataaattaatgataacaaagaataaaaagacgaataaaggctgcaggagaaaggtaataattgacttaaatcaaatgttacttttgtttaataattacaatcgatgactatcgtgtgatgtatatcgcatcatcaatttaaagtcaggtgggatgcctgtctgttaacgcccctttgggattggggggttctgctgagcatctatgaagctgaataaaacttatataaatatcagagataaatggtggggactaccgctcattctcccttcgattttactacctgttttaagtagcgcaaatacttatgcgcttaccagcactggaaatgtggttcttttttacctgccgttagcttttatgcttagtctgatgctctttttcggctgggcagcactgccgggcattgtgcttgctatcttctggcgcagatacccgcagacagggctgtatgaaaccctttctgtgacgatgcactttatcattactatcgtgctaagctggggcggctatcgtgtcttttccccccggcgaaacaatgtttcccacggcgacgcccacctgttgtttcaacgaatgttctggcaggtattttgttcagcgacattatttctggtcatttaccagtttgccgcttttgttggcatgtacgaaagtaaagccagcctgatgggggtaatgccctttaatatcaacacgctgattaattaccaggcgttactggtcggtaaccttgtcggcgtgccattgtgctattttattattcgtactctccgcaatccgctgcacctgcgggggtattatcagcaattaaagctacagattgatagcaaggccactaaaaaagagatcgttatttggctggctgtattgactacactaatgtttatactgtgtatgccattgacggataatagctcaatatttagtaccaactatacgctttcgttattattgccggtcatgctgtggggcgcgatgcgctatggttataagtttatttcaattatctgggccgtcgtgctaattacgtcgattcattattatcagcgttatatgccctggtattcaggttatgatacgcaattagcgattacctcttcgagctatctggttttttcttttattgttaattatatgtctgtactggccacgcgtcagcgcgtagtgagtggtcgcgcacggcggctggcctatcttgacccggttgtacatcttcccaatttacgtgcgttaaaccgcgcgcttaaaaatgcaccctggtctacgatctgttttttacacgtgccgggtctggagctattgggtaaaaattatggcgtcatgctacgcatccagtataagcaaaagctctctcactggattacgccgatgttggcctcaaatgagtgcgtctaccagatgtcagggcacgacctggtgctgcgtcttaatacagaggcgcatcagcagcgtattgaagcgctggataaacatattaagcagtttcggtttatttgggatggactgccgctacagccgcctgttggcgtgagctactgctgcgtgcgttctccggttagccacctttatctgctgttgggcgaattaagcaccagttccgatctttcgttgacgactaacgcgccggaggatttacagcggcgcggcgcaatgcacctgcagcgcgatttgaagggcagaattgcgatgatgaatcgcctgcaacaggcgttggagcacgatcattttttcctgatggcgcagcctattttcggtgttcgtggggacgtttaccatgaaattttactgcgactcagggatgacaacggcgacgttatcaacccggacaattttttacccgtggcgcatgagtttggtttgtcttccgctatcgatctctgggtgattgaaaacacgctacggtttatggcggccagccgggaatatatgcccgcgcatcgttttgccattaatctgtcgccaacatcggtatgccgcgcccgtttccctgcagaagttaagcagctgcttacgcaatatcaggttgaaccctggcaactggtttttgaggtaacggaaagcaactctctcaccaatgctgagcaggcgcagttgacactgggacagctacagcagtttggctgtcagatagcgattgatgatttcggtactggctacgccagctatgcgcggctgaaaaacgttgacgccgatattcttaaaattgacggcagttttattcgcaatatagtgtcaaacagtctcgattatcagattgtggcttctatttgtcatttagcgcgaatgaaaaatatgcaggtcgtcgcggagtatatcgagagcgaagaaatacgaagcgtagtgctgtcgttggggatcgactatcttcagggatatttaattggcgagccgcagctattatctgagattcagtaaaggcagacgccgcagcgcggcgtctgatccacaatttacgcggcgatctccggcgagctttcttcctcaatattgagacgccagccagttaccgcttcccagtactgctgttctttttccagatcaagcagtaccagcgcattctggctgaaccagtcatgcggaaaacataacgtccagtggctgtcatcggtcgttagccgcagcgtcggcggtgtggtggtcgcctgccgctggttgttcagtaatacgcccagccgaagtagctgaattaacggcagatactgttttttcttaaacagcgtaaagcggggcatatcatccagttttatggctttacgatgataacgcaccagcgtcgccatcatcatttgctgctcctgattaaagccgggcaaatcgctgtgttgcagaatataagccgaatggcgatgtaaaccgctgtgattaatattcagtccaacctcatgcagcattgccgcccagcggagcaacgcttcaagctgcggatgcgccagttttggctgctgggcctgccactgctcgtacatctgcatggtggtttccagcacacgtctggcctgttctctgtcaatgttgtattgattggccagactttttgcggtacggctgcgaacatcctgatggcggaagcggccttccatttcatacagcacgccttcgcgcaacgcgccgtcggaaaggcgaagctcgcggatagccagagcatcaaaaacgccgcacagaatcgccaggcccggcacaaagaccgcttttcgttcttcagacagacccggcaggctgagcgcattaaaggagcggtgcttcaacacttctgacttcagtttatcgaggcgctccggcgtaatgaagccatctttctcacccagcgccaggagaacttcatgagcggccttaatcgtaccggaagcgcccatcgccacgttccaaccctgaatacgatactgccaggttaaggtttccagtttttgcgctgccgccattcgggcgcgctggaagttttctttattgataacgccgccgggaaagtagagctgcgcgaagctcacgcagcccatacgacggctttcaaccagcctgggttcgaagttttcgccaataaccagctctgttgatccgccgccgatatcgatcaccagcttgcggcctttttccggctgcgtatgttctacgcccataaaaatcaggcgcgcttcttcgttaccggaaataatctctatcgggtagggaataaccttttccgcgcgtttgagaaaatcagcggcattttgcgcctgacgtaacgtatgggtgcctacgatacaaacgctggaaggggagaaaccttgtaagcgttcagcaaacagcgacagacagctaagcccccgttccatggcttcttcgctgagtttgttatctgcgcccagcccgtccgccagatggacgcgctgttttaagcgcccgataatctgcattgcgccgtcaaccacgcgggcaatgaccatatgaaagctgtttgagccgagatcgaccgcagcgaactcctgcgggcgaggggatttatcgtaaattggcatagcgttagtctggttgctcgagtgatttgatgtagtcataaattgccagctgcgcctgaactttgcggcgattgccgcgcggtacgtagcggttgctgagttctttatcgataaaacgcgcttttaccgtgtcgctaaacagaatgtcaatgatatccaggacgcgttgtttaagccgcgggtcgaggataggcgtagcgacttcgatacggtagtcaatattacgcgtcatccagtcagctgaagagagccaaacttgcttatcaccgccgttttcgaaaatataaacccgatcgtgttccagatagcgatccacgatgctaatcgcgcgaatattatcgctaatgccttccagttgcggaataagagaacacataccgcgcaccagcagattgacctggacgcccgaacccgacgcggcgtatagcctgtcgaccaaccctttatcgaccaggttgttaagctttaaggtaatccctgacggtaagccttgctgggcattggcaatttcacgatcgatcatctcatacagcagacgccgtgagttttgtggagaaaccatcaaataatcgaaagtgaccgggcgataggggttttcaataaaattaaagacccggcgcacttcattggtaatgcgcgcatcggcggtcagcagcgaataatcggtatacagccgcgccgttttttcgttgaagttaccggtgccgatatgcgcataacgcaccacgtcatcgccctcttttcgtgagatgagaaagagtttggcgtgaattttcagcccgggcgcagagaaaataacatggacgcccgcttcggttaaccgcttggcccagtgaatattcgcctcttcatcgaagcgcgcctgcaactccaccaccacggtgacttttttgccgttatgggcggcatggatcatcgagtcaataatgcgcgagtctttcgctacgcgataaatattgattttgatcgccagcacgcttgggtcaaacgacgcctggcgcagcagttccagtacatgctcgaaggtatggtacggataatagagcagcacatcacgttcacgaatcgcgtcgaaaccgttacgaaacttctctttatcaaaccaaagatggcgtaaccgcggtaacggtttattgaccaggttggctttaccgacattcggaaaattaataaagtctttaaaattgtggtagcgcccgccgggtacgattgagtcataccgggagatcgtcagtttttcccgcagcacgtcgaccagcgcggcgggcatatcgcgttgatagacaaagcgcacaggttcagcggtcaggcgctgcttcaggctggaggacatcagctccatcagactggattccatctcatgcaccaggtcatattcggcatcgcgggtcattttcatcgaataggcattgagcgcgtcatagtcgaagaaccctttaaaaatgtcatccaggcagtagcgcagaatattatccagtaggatcatcggcttgcgtctgcgcggtgtctccggcggcagattaacgaagcgtgggactttgtcggacggtatctccagcagcgcatagttgatggtgtcgccgcggataatctccaccgccagataggtgtaatcatcttttaaaaactgaacaagatccgtctcccggttaatgagaatcggggtaatatgctggcgcaaatagtgcttaaaatagtggcgcaaccagctttgttggttcaccgagagctgacgctcgttgatcagaaagatttgattacgcgccatttccagcagtaattcgttgtacaggccgtcgaacccctggtctgctttcaacacgcgggactgaattttgcctaacaaatggcgtgaatgagaatttgaaccctgttcttcgctgataataatgcgtcgtttcagttcagcgaaacgcactttgtagaactcgtcgaggttattagaatagattcccaggaaccgcatccgctcaatcaacgggttggatttatccgctgcttcctgtaacacgcgttcgttaaatgctaaccagctcagctctttctcgatatatagcttttcctgacccattactacctatactccgttttattcacgggacactgcctgataattatggcgagcattacgcgttaatgtccaacagcgtcagaaaaatatgacaataaactgatagcataaaggaagggaaaagagtaggccggataggcatttacgccgccatccggcaagcagacgcagccctggccgatgacatattattcgtcagacgcataaccttgcggcggcagacgacgcccgtccagccaggcggcgttatcgcgcatctttagacgcccctgcgcaaaccagccaatcaccagcggataaatcgcatgttcctgagtttgtacgcgtgcggtgatatcatcttcgctgtcgttggcaaaaaccggcaccttcgcctggagaatgaccgggccgccgtcgagttcgtctgtcacgaaatgcaccgaggtaccgtgctcctcatcgccgttttccagcgcctggcgatgggtatgcaaccccggatattttggcagcagggaagggtgaatgttcagcagacgcccgtagtaatgcgcgacaaacatcggactcagaatacgcataaaaccggccagcacgaccacatcgggcgcatacgcgtctatcttgcgaatcaactcgcgatcgaaggcgtcgcggctgtcaaaccgatcggcagtcagcgcttgcgccggaatgccggcttctctggcgcgttcaaggccgaacgcgtcggccttattgctgaatactgccctgagggtgcctttaattttcttcgcttcgcaggcatcgataatcgcctgtaaattgcttccattgccggaaatcagcaccacaatattcattattcaataaccacacgctgttcggaatcagaggctttgatgataccgattttccatgcgttttcacctttctcgtttagcagagcaagcgctttgtccgcttccggagcagagagcgcaatcaccatgccgacgccgcagttaaaggcacggtacatttcatgtcggctgacattaccggcggttcgcagccaggtaaagatggcgggccactgccaggacgactcattaattaccgcctgggtattctccggcagaacgcgcggaatattttcccaaaagccgccgccggtgaggtgggcgatagcgtgtacatcgatgttttcaatcagttccagaaccgattttacgtagatacgggtcggttcaagcagatgatcggccagcggtttcccttccagcagagtggtctgtggatcgcagccgctaacgtcaataattttccgcaccagcgaatatccattcgagtgcgggccgctggagccgagcgcaatcagcacgtcgccttcggcaacccgggagccatcgatgatttctgatttttcgactacgccgacgcagaaacccgccacatcgtaatcttcgccgtgatacatgcccggcatttccgccgtctcgccgccgaccagcgcgcagccggattgcaggcagccttcggcaataccgttgatcacgctggcggcggtatcgacatccagtttaccggtggcatagtaatcgaggaaaaacagcggttccgcgccctgaacgaccagatcgtttacgcacatcgccaccagatcaataccgatagcgtcgtgacgctttaagtccatcgccaggcgaagtttggtgcctacgccgtcagtgccggaaaccagtaccggttcacgatatttttgcggcaacgcgcacagcgcaccgaaaccgcccagaccgcccataacctccgagcggcgagttttcttcactacgcctttgattcgatcaaccagagcgttacccgcatcaatatcgacgccggcatctttatagctaagagaggtcttatcggtcactgcctggttccccacgttttttcttgcggtaaaagttaaattcggcgcaattctaacagggaaagcaaacgtttgcgagcgtggtctgcgccctggttatccgggcgattttttggcatggtttcggtcgctgcttgaaaatttccctgttggtaaaaaagaaaaggatatccagcacttggtttacgacaggtggtcgggacaggtcattcacccttaaaattgctaagattcaatcggttgttagcttttatcgccagtttcaacgtgagtgatttatactcacttttccgctatcagcgcttttggttgatccaggtcaagcatacattgtgttgcgtcagagaggaaaagcggtataatccggcgattttttttgtggttgccagtcatctgaggataggagaagagtatgaagatcgtggaagtcaaacacccactcgtcaaacacaagctgggtctgatgcgtgaaaacgacattagcactaaacgctttcgtgaactcgcctcagaagtaggcagcctgctgacgtatgaagcgacagccgacctggaaacggaaaaagtcaccatcgaaggctggaatggcccggtggaaatcgaccagatcaaaggtaaaaaaattaccgttgtgccgattctgcgcgcggggttgggcatgatggaaggcgttctggaaaatgtaccgagcgcgcgtatcagcgtagtcgggatgtaccgtaacgaagagacgctcgagccagtaccttatttccagaaactggtatcgaacattgatgagcgcatggcgctgatcgtcgacccgatgctggcgaccggcggttctgtcatcgcgaccatcgacctgctgaaaaaagcaggctgtagcagcattaaggtgctggtgctggtcgccgcgccggaaggcattgcggcgctggaaaaagcgcacccggacgttgaactgtacaccgcctctatcgatcaggggcttaacgagcacggatacattattccggggcttggcgatgccggcgataagatttttggtaccaaataagtgaataaataattaaaagccgactttaagagtcggcttttttttgaataaaaccactaataacaaacacacttagaggaaaacactatgacgcgccgtgctatcggggtgagtgaaagaccgccgcttttacagacaatcccgcttagtttacagcaccttttcgccatgtttggcgcgaccgtgctggtgccagttctgtttcatatcaatcccgcgacggtgctgctgtttaacggtatcggaacgttgctgtatctctttatctgcaaaggtaaaattcctgcctacctcggatcgagctttgcctttatttccccggtattactgttgttgccgctgggttatgaagtggcgctgggcggttttattatgtgcggcgtgttgttctgtctggtctctttcatcgttaaaaaagcgggcaccggctggctggatgtgatgttcccgcctgcggcaatgggcgcaatcgttgccgtcatcggtctggagctggctggcgtcgcggcggggatggccggattgctgcctgcgcaagggcagtcgccggacacgaaaacaattattatctccatggtcacgctggcggtgacggtgttcggctccgtactgtttcgcggtttcctggcgatcattccgattttgatcggcgtgctggcgggctatgcgctgtcattcgcgctgggggtggtcgataccacgccgattgcccaggcgcactggtttgcgctgccgaccttctatacgccgcgttttgaatggtttgcgatcctgacgattctgcccgcggcgttggtcgtgatcgccgagcatgtcggtcatctggtggtgacggcgaatatcgtcaaaaaagatttagtgcgcgatcccggtttgcaccgctcgatgttcgctaacggactgtcgacgatcatttccggtttcttcggctccacgccgaataccacctatggggaaaatattggcgtcatggcgatcacccgcgtttacagtacctgggttatcggcggcgcggcgattttcgccattctgctttcctgcgtcggcaaactggcggcggcgattcagattatcccgttacccgtgatgggcggcgtctcgctgctgttgtacggcgtcatcggcgcgtcggggattcgcgtcttgatcgaatcgaaagtcgactacaacaaagcgcaaaacctgatcctcacctcggtgattttgatcatcggcgttagcggcgcgaaagtgcatatcggcgcggcagaattgaaagggatggcgctggcgaccatcgtcgggattggcctgagcctgatttttaaactgattagcctgttgcgtccggaagaagtggtactggaggcaaatgatgcggagtctccgcatcagtaacgggttgccgggcagcgatgctgcccggttctatctcacgggaattatgtggtaaactcagcgcgattttatgtcatcctgggttgaggtatctctgaacacaccggcacagctctctttgccactttatcttcctgacgacgaaactttcgcaagtttctggccgggggataacgcctctctactggccgcgttacaaaacgtgttgcgccaggaacatagtggatatatctacctttgggcgcgtgaaggcgcgggccgcagccatttgctgcacgccgcctgcgctgaactgtcgcagcgtggagatgcggtaggctacgtcccgctcgataaacgcacctggttcgtgccggaagtgctcgacggtatggaacacctctcgctggtgtgtattgataacattgagtgcgtcgctggcgatgaactgtgggagatggccatctttgatctctataaccgcattctggagtccggtaagacgcggttattgatcaccggcgatcgtccgccaagacagttaaatctgggcttacccgatctcgcttcccgtctggactgggggcaaatctataaactccagcctctttccgatgaagacaaacttcaggcgctacagttgcgtgcccgattacgggggtttgaactgccggaagatgtcggacggtttttactcaaacgtcttgatcgcgaaatgcgcacgctgtttatgacgctggatcagctcgatcatgcgtcgatcactgcccagcgaaaactgacgatcccgtttgtcaaagagatcctgaaactgtaatacgccgcgacggcggcgtttaacggttaaccgaggatgtccagcacctgctcaggcggtcggccaatacgcgcctgaccatttgccactacaatggggcgctccatcagtttagggtgttcaaccagcgcctggattaacgcctcttcacttagctggctatccgccaggtgaagcgtcttatagagatcttctttctggcgcatcagttcgcgcgcgctggacatgcccaacatacgcagcagttcccgcacggtggcggcatcggcgggcgtatccagataaagcaccacttccggttccacgccgttagatttcagcaggttcagcgtgtcgcggctcttcgagcagcgcgggttatggtagattttaatcgtgtcggtcatgagttctccttgtgacgccatccggctaataaacggcgattacattttcgtgtatggcttgaagcgttcctgtaactggcgcaactggtcgatacgcgcatcgtaacgcgcctgttgctgactacccagttttgcctgggcgctggcgctgctgagcagtgaaattgcctgatccagtcgtcccgccagcgcataactttcagcgcgtgccgccagctcctgatcgcggttgttcagcgcggcttcggcctgagcaagcagatcccagccgttaccgtcatctttatggctaaaggtgtagcgattcagaatggtttccgccgctttcggctggcctccctggaggtacgcattggcgaggtttaactgcagcacaggattaacgcgcagatcgcgggcatttttcaggcgattaatcgcgtcgttggctcttttctgccccaggtcaatatcggtggcgaggtcaagataccaggcattgttcggctctgcgcttaatagcggctgcaacgttttgcgcgcttcatcgtacttgctcgcttccatcgcctgcaacgcccggccatattgcgccgcatgttgctgacgcacgttgcctttagaccactgatccagcaggtcgctggtgagctggttacgtccggaattgtacattcccagggcgcgcgctttggcgaaataaaagtcggcggaagattgcaccacgaccgggcgcatctggttggcacggttgcgggcatccgcaaggcggctttccggtaaggggtgagtgagcaaaatttcaggcggtcgcgtggagtaacgcgcctggtcgagcagtttttcgaggaaagagggcatcgcctgtgggtcaaatccggcgcgttgcagtacctgaataccaatacggtcggcctcttgctcattttgctgggtgaaacttatcattccctggcgcgttcccgccagagtaccggttagcgccgccataccggcctgtgggctggccatggccagcaaaatggaacccagcgcgcccacccaggtaagcggcgcgctgcgcttttgatcttccatcgcgcgcgccagatggcgctgcgtaacgtgggaaatttcatgcgccatgactgaagctagctggctttcgttatccgcgtagcgaaaaagcgccgagtgcagcaccacattgccgccaaagaacgcgaacgcgttgatttcgtcattattgatcaagaaaaaatggaagggcgttttgacggagtctgcgtgcgagaccagacgcatccccagcgcgttaatgtattgcaccagcagcggatcgttgattaacggcgcgctgccgcgtagctggcgcacataaaagtcgcccatttgcatctcttgtccaatagaaagcgtgcttcctgccgaggttcccatatcgggcagcgtgtcggcagggtcggcaaatgcgggcgcgacctgaccgagagccaatgctgcaatgagggttgccaccaggttttttttcaactgcctgaacataacctctatcctgttgttttgagatagccctttgaccaacgtcgtgaaatatcgttccacgctccgacacttcataagtgtaactgtgatgagcacagactcactattttagtttcctgaatcaacgataaaaagcgaagtcttttttgtgacatttcgatacaattcggcatcacaatcccgcagttgagttctgggaagggttttatgctcgaaatgttaatgcaatggtatcgccgtcgcttcagcgatccggaggcgattgccttgctggtcattctggtggctggttttagcatcctctttttctttagcggcctgttagcgccgctgctggtcgctatcgtactggcctacctgctggagtggccgacggcgcgcctgcaggcgattggctgttcccggcgctgggcagcctccattgtccttatcctctttgtcggcattctgttattaatggcgtttgtggtgatgccgattgcctggcagcagggtatttacctgattcgtgatatgcctggtatgctgaataaactgtccgattttgccgcgaccttgccgcgacgctatccggcgctgatggatgcgggcattattgatgcgatggcggaaaacatgcgtacccggatgcttaacatgggcgattcggtggtgaaatattcgctggcttcgttagtcgggctactgacgctggcggtatatctggtgctggtgccgctgatggtctttttcctggtaaaagataaagagcagatgctgaatgccgtgcgccgcgtgctgccgcgtaatcgcgggctggcggggcaggtgtggaatgagatgaatcagcagatcaccaactatatccgcggaaaagtgctggagatggtagtggtgggcgtggcgacctggctgggctttttgttgtttggcctcaactattcgctactgttggcggtactggtgggcttttcggtcctgatcccctatatcggcgcctttgtggtgacaattccggtggtgggcgtcgcgctgtttcagtttggtctggggacggaattctggagctgttttgccgtttatctgattattcaggcgctggatggcaatttgctggtaccggtacttttctccgaagcggtgaatttgcatccgctggtgattattctgtcagtggtgattttcggcggtctgtggggattctggggggtatttttcgccattccattggcgacgctgattaaagccgttgtccatgcctggccggatggtcaggtgacggatgcctcatcctgagcggtctgtacaaaagttgtaaagcgtgaacgacatcatagtgccctgccgccattttgcgcacgcctgatgagggtcaagcgcttagaaagccgctcttttttttaatgccgcaccgtgttgcggcatttttattgtcggaacctacaaaattctcgctgtaaagccgccaaaatttggtgacttagcctaagcattcttctgagaaattcgttaataagtgacatcattgatgcgagattgcttttttaatgtgaagcgataacgaaacagggaatgagtgtgttgagaaaacattacttgaaagggtataccgcgcggcaaattgtacagcgagccatgaaaattattccttactcggtaaacgtcatggatgagcatggcgtcattatcgcgtctggcgaaccttcgcggcttcgccagcgtcacgaaggggccattctggcgctgaaggaaaaccgtattgtagaaattgattccgctaccgccaatcagcttaaaggcgtgcgatccggcattaatcttcccatctcttttcatgaacagcttatcggcgtggtcggcattaccggcgaaccggaggaggttcgcgcgtatgccgagctggttaaaatggcggcggagctggtgatcgagcatatggtgctgatcgaacagtgacaatgggataaacgctatcgcgaagagctgatcaaccaattgattttgcgagaaaattcaacagagtcgttgcgctccatggcggcctatctgggcattgatctggcggttcccagagtggtgctgattattgaactttcccagccggatcgcgaagcgctgcgcaatgtaatggattatttcgagaatcacgcgcgcaaccatttggtgacgtttaccgaatttaatgaattaatcattattaagcctatcacgttaaaagagggaaagtggaatacccgccaggaaatgggcgaattgcagatttttaaatcatgggctgcatcatcgggctttagccgtattttggttgggggctattttgccggcgagacgggattgcaccgatctttgctcacagcgagagccacgcaggcgatggcgaaaagacaaaagctgcgcagccagtacattttttatcatgaccacgcgcttcccgcgctgctaagcgggctgtctgaaagttggcaagtgcaggagttatcgcgtctgtggctgcaactggtgcaacatgacgcgaaaggcgtattgcaacagacgctgcggacttggtttgaacataattgtgacctgacgcaaacggccaaagcattgcatattcatgtgaatacattgcgctatcgcttacagcgctgtgaggatattacgcacataaaaatcaacgagttaaaaagtacgctttggctttatatcggtatggagcttcaggccgaatctgtatcgtccgacaagttaccgctgcctggtcgaatcgaaatttgttgaaagctccagcggatttttaggcggttttttccatactgcgcgctccatgttaaaggaggcgcagtatatgacgtcgatatccaccttgggagccattgccgcattggttgtggccatcgtattaattttaagaaaagtgtcgccagcctacggcatgatggcgggcgcgctggtcggcggtttgattggcggcgccgatcttctgcaaaccgtgtcgctgatggtgtcaggcgcgcagggcatcgttaatgccgtattgcgtattctggccgcaggcgtactggcgggcgtattaattgagtccggggcggcgaatacgattgctgagacgattgtccgcaaagtgggggaaacccgggcattattggcattagccattgccacactatgtttgaccgccgtcggcgtatttattgatgtggcggtgattaccgtcgcgccgattgcgctgtcgattgcgcgtaatgcaggcctgtcaaaaagcgctattctgctggcgatggtcggcggcggcaaagcgggtaacgtgatgtcacctaacccgaacgctattgccgcctccgatgcgtttcatgttcctcttacctctattatgctggcgggcgtggttccgggcatcgttgggcttattatcgcctatctgttagcgaaacggctgaataataaaggcgcgggcgtcgccgatcatgaagtgactcaccatgatgactctgtcgccaggcccggttttctggtggcgattagcgcgccgctggtcgctattttcctgctttctctccgtccgtttgtcggcatttccattgacccgttaattgccctgcccgtagggggattggtcggtctgctgttgatgggacgcgcgcgccactgtaaccagtacatggtcgccggtctgatgcgtatggcgcctgtcgctattatgttgctgggaaccggtacgctggccggcattatcgctaattccgaacttaaagatgtcctgattcatggcctcaccgcttcgggattgccgtcctggctgctggcgcccgtgtctggcgccatgatgtcaatggcgacggcctcaaccacagcgggaacggcggtggcgtccggcgttttctctcccacgttacttgaacttggcgtttccgccctggcgggagccgctatgatccatgcgggcgccacggtgctggaccatctgccgcatggcagctttttccacgcgacgggcggcagcgtcaatatgcaaattcatgaacgtttaaagctaatgccgtatgaaacgctggtggggttagccattacctttatttctactctgatgttcggtttctttggttttgcaggataatccctatgaaaattgttattgctcctgattcatttaaagaaagtttgtccgcaatggcggtcgctgaggcgatagaaaaggggttccgcgaaatttatcctgacgccgactacgttaaggtgcccatggcggatggcggggaaggaaccgtgcaatcaatggtggaagctagcggcgggcgttatgttgaccagtgggtacaaggcccgcttgggcaaccggtaaccgcgcgttggggaatgctgggcgatagcgataccgccgtgattgaaatggcggcggcatccgggctgcatcacgtttcgcctgaattgcgtaacccgcttaatactaccagctacggcaccggcgagttaatcgtcgcggcgctggagcgtggcgtaaagcgtattattctgggaattggcggcagtgcgacgaatgacggcggcgcggggatgatgcaggcgcttggcgttatattgcgcgataaacaggggcgctcgctttctccgggcggcgaggcgctggcggcgctggcgtctatcgatttgtccggttgtcacccattgctgcgtaaggtatcgataaccgtggcgtgtgatgtcaacaatccgctgtgtggtccccagggcgcatcggccatctttggcccacaaaaaggggcgacagcggaaatggtgaactccctggacgcggcgctggaaaactggggccgacatatttatcaggcaacgggacgtgaggtgattaacgctcccggcgcgggcgcggcaggcggaatgggcgccgcgcttttagggttgctcaatgcggaattacgcgccggcgtagagattgtcgtggaaacgctacagcttgagcaggcggttaaagatgccgatctggtgattaccggagaagggcggctggacagccaaagtatttgcggcaagacgccgattggcgtcgccagagtggcgaagcggcatcataaaccggttatcgcgctcgccggtgggctgcaacacgatcatcacgttgtgtatcagcagggtatcgatgcggcgctatcgattttgtcgcatatcgttacgctgccggaagccttacacgaggcggaatataacctgagcctgtcggcgcgcaatgtggcggcgatatggcgtctggcgcggcaagcctgacggcgcattccctttccaggccgcacatcagcgcggcctgaggcttttacgcgttttctttcagccagttcagcaccacatcatggtgattgctggttttaaaatcattaaagacgtgctcaatcttaccatcagcgtcaatcaaaaagctgatgcggtgaatgccgtcatacgttttgcccataaacgacttttcgccccagacgccaaactgttcacacacctgatggttttcatcggacaaaagggtaaagttcagcagctctttttcagcgaaacgggagagtttttcaggtttatcggtgctgatgcccagcacgtccacgcctgcttttttaagctcgtccatgttatcgcgtaagccgcaggcctgcacggtacagccgggtgtcatggcttttgggtagaaataaaccagaacgcgctgcccctggaagtcggtcaaatttacttgttccccgtcttgatccggcaagctaaatttcggtgcgatatcaccggctttcagtggattcattacttaactccatcctgttcatcatgttgtgagtaattgacgacgtttatactgccttgcgcattgagttctgtacatagtgctttaaaggcttgctcaatatttgcggaattttgcgacgccgggctatgtgcggtgatttgaataaataattgcgcagctttatcatcttcagccggctgcgtgcgggagaccagctccgcaatattcatttcatgactattaaacagcgcggtgaatcgctcaattaaatgcggggagtcggcgacctcaacctgaacccataccgtcgcgggcattgccgggcgggggcggtcggacgtccgtttcatcacaatcagcagatccagctccgcgccttttaacggcaatgtcgattcaatcaaggtaatcgcgttccacgtgccggacaacagcataataaacgtgaattcatcgcccagcatcgccagtcggctgtcttcgatattacagccgcaactgctgacatggcgagtaatggtattcacaataccgggcctgtcggcgcccagcgcagtgataaccaaatagtgttgtgatgacggtgtcaaaccagttattcctttgagcggtgaggtaatcttaaggaaaccataaaaaaaacctgcatacaacaatcagaacggctttggtcgcttgcttttattgtcataccaaacgtaccattgagggacttgtttgcacagaggatggcccatgttcacgggaagtattgtcgcgcttgttacgccgatggatgagaaaggtaacgtcagtaggtcttgcctgaaaaaactcattgattatcatgtcgccaacggtacctcggcgattgtttcggttggcaccaccggcgagtctgccacgctaagccatgatgaacatggcgatgtcgtgatgatgacgctggaactggctgacggacgtattccggttatcgctggcacgggcgcaaacgcgaccgcggaagcgattagcctgacgcagcgttttaacgatagcggcattgttggctgcctgacggtaacgccgtactacaatcgccccacgcaggaaggtttgttccagcatttcaaagccatcgcggaacacactgacttgccgcaaattctgtataatgtgccgtcccgtaccggttgcgacatgttgccggaaaccgtgggtcgtctggcggaaataaaaaatattatcgctatcaaagaggcgacagggaacttaacccgcgttcaccagatcaaagagctggtttcagacgattttattctgcttagcggcgatgacgcgtccgcgctggactttatgcaactgggtggtcatggcgtgatttccgttactgctaacgtagcggcgcgcgatatggctgacatgtgcaaactggcggcggaagggcaatttgccgaggcgcgcgctatcaaccagcgtctgatgccgttacacaacaaactatttgtcgaacccaatcctatcccggtgaaatgggcatgtaaggcattgggtcttgtggcgaccgacacgctgcgcctgccaatgacgcctatcaccgaccatggtcgtgacatcgtcaaagcagcgcttcagcatgctggcctgctgtaaagtttagggagatttgatggcttactcagtacaaaagtcgcgcctggcgaaggttgcgggtgtttcgcttgttttgctgctcgctgcctgtagttccgattcgcgctacaagcgccaggtaagcggcgatgaatcctatctggatgccgcgccgcttgctgaacttcacgccccggcaggaatgattctgccgataacgaccggcgactacgttattccggtcacgaaggggagcggcgcggttggtaaggcgttggatatccgtccgccggcgcagccgttagcgttagtgagcggcgcgcgtacccagttctctggcgataccgctacgctattggtggaaaatggccgtagcagcacgctgtggccgcaagtcgtcagcgtgattcaggcgaaaaattatccgattgaaaaacgtgacgatgccagccagaccctgacgaccgattgggtgagctggaaccgcctggatgaagacgaacagtatcgcggacgttatcaaatctcggtgaagccgcagggctatcagcaggcggtaacggtaaaactggttaatctggaacaggctggcaagccggtcgctgatgcggcgtcgctgcagcgctatagcactgaaatgatgaacgtcatttccgccggtctggataagaccgctacggatgcggcaaatgccgcgcagaaccgttccgccgcaacgatggatgtgcagagcgccgctgatgataccggtttacctatgctggtcgttcgcggtccgttcaacctcgtgtggcagcgtctcccggccgcgctggaaaaagtgggcatgaaagtcaccgacagcactcgctctcagggcagcatggcggtaacgtacaaaccgttgtctgacagcgactggcgggatctgggcgctagcgacccgggcctggcatccggagactataaattgcaggtcggcgatttagataaccgcagcagcttgcagtttatcgatcctaaggggcatactctgacgcaaagccagaacgacgcgctggttgccgtcttccaggctgcgttcaacaagtaatttaacagggctggagcaatccggcccttttttctgataagatacgcaaacgtgtgcgtcggtacaaaaacgcgatttaaccgctatttcgcaccacaattacaggccggcgtctctggcaggcgtagcaggaaatgaatacttatcgttaattcacacccaggagtgttaaagatgcaaaagcaagctgagttgtatcgtggtaaagcgaaaaccgtatacagcacggaaaacccggacctgttggtgctcgaattccgcaatgatacgtcagcaggggatggcgcgcgcattgaacagtttgatcgcaaaggcatggtaaataacaaattcaaccatttcattatgaccaaactggccgaggcgggcatcccgacccagatggaacgtttgctgtctgataccgagtgtctggtgaagaagctggagatggtgccggttgaatgtgtggtgcgcaaccgtgcggcagggtcgctggtcaagcgtctgggcgtggaagaaggcatggagcttaacccgccgatcttcgatctgttcctgaaaaacgacgcgctgcacgacccgatggtgaatagttcctactgtgaaactttcgggtgggtaagccaggaaaatctggcgcgtatgaaagagctaacctacaaagccaacgacgtactaaaaaaactgtttgatgacgcgggtcttatcctggtggatttcaaactggagtttggcctgtataaaggcgaagtggtgctgggcgatgagttttcaccggacggtagccgcctgtgggataaagagacgctggacaaaatggacaaagaccgcttccgccagagcctgggcggtctgattgaagcctatgaagccgttgcgcatcgcctgggcgtgaaattagattaattccgcttctgaccgggggggcaaccgctctccggtatcatcctttcctcattctgatagcgtttacctgtggtaatcctgcgcctgaccgcctacgatcatctgtataacaaagagagaatgaggtgattatgcgctggcaagggcgtcgtgaaagtaacaatgtagaggacagacgtaatcggccaggcggcccctcgctgggtggccctggctttcgtcttccgcgcgggaaaggcggcatcattctgttggtggtggtggtggtcgcagggtactatggggtggatttaaccggtctgttgactggtcagccggtttcgcagcagcagtcgacgcgttcgataagccccaatgatgatgaagcggcaaaatttacctcggtgattctggcgacgaccgaagatacctgggggcaactctttcaaaaaatggggcgcggctatcagcagccaaaactggtgatgtaccgtggtatgacgcgtaccggctgtggtgcgggtcagtccgtgatggggccgttttactgcccggcggacggcaccgtctatatcgatctctcattttacgatgttatgaaaaataagctgggcgcggacggtgattttgcccagggttatgttatcgcccacgaagtcggccaccacgtacaaaaactgttaggcattgagccgaaagtacgccagttacaacaaaacgcgtcgcaaacggaggtgaatcgcctttcggtgcgcatggagctacaggcggattgctttgccggcgtgtggggacacagtatgcagcagcaaggcgtactggaggcgggcgatctggaagaggcgctcaatgccgcacaggctatcggcgacgatcgcttacagcaacaggggcaggggcgcgtggtgccggatagttttacccacggcacctcagaacagcgctacagctggtttaagcgtggatttgacagcggtgacccggcgcaatgtaatacgtttggtaaaaacttttgataaactggggcagggatgtctgatatcgatgcgctacgggcgttaacgtcgcaaatgacacaggaaggcattcgccgtttactggtcatcagcggcgatgcggcgtggtgccgggaacgggccgaggcgatacgcgctgtattgcccggtgactggtgggtcgcgcctgacgcgcccgcccagccgcgctgtacgccacaggcgttacaaacgctgctgggccgtgaatttcgtcatgcgatatttgatgcctggcagggctttgacgccgcagcgtttgccgccctgagcgggaccttgcaggccggaagttggctgcttctgctgatgccgccgtatgagacgtgggaaagccggcctgataccgattcactgcgctggagcgactgcgcgcagcctatccccacaccgcagtttgcacagcatcttaaacggactctttcccgcgatccgcaaacgctgctttggcgacagcgccagccgttttgctggccatcttatccttcccgcgaacgctggcgacccgccaccggcgagccgcagccggagcaggcggctatcttatcgcgtttacgtgaaatgccgcccggcgtggcgacggtgattgccccccgtgggcgcggcaaatcggcgctggccgggcaattcatctcacagatggcgggcacggctatcgtgaccgcaccggcgaaaacggcaacggatatcctggcagcgtttgccggtgagcggttctgctttatggcgccggatgcgctgctggcgagcggggcaagagccgactggctggtggttgacgaggcggcggcaatccccgcgccgctgctgctgcaactggtttcgcgctttccccgcatactactcaccaccaccgttcagggctacgaaggcaccggacgcggttttttacttaagttttgcgcccgttttccgcagcttcaccgctttacgcttcgtcagcctgtccgctgggcgccagaatgcccgctggaaaatatcgtcagcgaggcgctgatattcgacgatgaagcgtttgcgcaggcgccgcatggcgggatagcaatctcggcattttaccagcaggcctgggggaagacgcccgcgttgccgagggctgtgtatcagttactgtcgggggcgcactatcgtacttcgccgttggatctgcgccgaatgatggatgcgccaggacagcatttcttgcaggctacggcgaataaccgtgtggcgggcgccctctggctggtcgaagagggcgggttatccgcagagctcagtcaggctgtatggtgcggtttccggcgtccgcgtggaaatctggtggcgcagtcgctggcggcgcacggtagcgaccctttagccgcgacgctggtcgggcgtcgcgtaagccgtatcgcggtgcaccccgcccgtcagcgcgaaggcatcggtcagcagttgattgcctgcgcgtgcgagcaggcggcgcagtgtgattatctttccgtcagcttcggctatacgccggagctgtggcgcttctggcaacgctgcggctttgtgctggtacggatgggcagccatcgggaggcgagcagcggttgctatacggcgatggcgttattgccgctgagcgacgcgggacaacggctggcgcaacaggaacaccgacgtttgcgccgcgatgcggatatcctgacgcagtggaacggcgaggcgataccgctggcggcgttgcgcgaacaggcgcttaatgatgaagactggcgtgagctggtcggttttgcgttcgcgcaccgcccgctactgacatcgttaggttgcctgcatcgtttactgcaatacagcgcattgccattgccggcgctgagagggcggctggaggaaaaagccagcgatgccgaactgtgcgcccggctacgcatttcaggccgtaaagctctgctggcgttgcagcgtgcgcaggcggcgcaggcgctaattgcgttggatgccggacgaacgcagcgtttgcgcgacgtaatgccaggcggtggggaccatgccggatagcgatacctgtccggcatgttatccggttactttttcggctgatctttcttcggccagtcgtcttcatcgtcccacttatcgttaaaatcgcgatgcgggggcagctcaggtttgttggcaaggaatttcttatggtcgatgcgtttgagatctttgatcacattcagcagtacgcctaccagaaacaccaataccagaatccaccaatattttgccagccagtccatgcttatttcctcttaccggaacgctcatcaggcgacgagctgttccataatacgttgatacatacgggccagtagctggagatcggcggcattcacacattcgttaattttatgaatggtggcgttcaccggccccagttctaccacctgcgctcccatacgggcgataaaacgtccgtcggacgtaccgcccgtcgtcagtaattgcggtttaatttcattatagtgctcaatggcgtttaccaccgcgtccaccagctttccgcgtgcggtcaggaacggctgaccggaaagccaccagtctacggtatagcgtagctgatgcttctcaagcagcgcatgtacccgttctttgatcatctcatcggtcagctccgtgctaaaacggaagttaaactgcacgaacagttcgccgggaatgacattattgctgccggtgcctgcctggatattggctatctgcatactggtggccgggaaaaagtcattgccccgatcccactcgatagcgaccagttcattgagaaaaggcgcggcgcgatgaacagggttatccgccagatgcggataggcaacgtgcccctgaacgccatgaatagtgaggttacaggtgagggaaccgcgacgcccgtttttgacgacatcgcccacaatttcagtactggaaggttcgccgaccagacagtaatccagccgctcgttacgggccatcagcgcttcaaccacctttacggtgccattttttgcgctggcttcttcatcagaggtaatcaaaaatgcgaggcggccccggtgatgaggatgctgtgcaacaaaacgttcagcagccaccaccatggccgccagtgaacctttcatatccgccgcgccgcgaccgaacaacattccgtcgcgaatcgtaggttcaaacggcggattgatccagcgatcgacatcgccagccggtacgacgtcagtatgcccggcgaacgccagcgtttcgccacgcccacgccatgcccaaaaattttgcgtgtcgccaaaatccatatgctcaatggtaaaaccgattttacgcaggcgttcaatcattaatgcctgacagcctacgtcatccggactcagggaggggcgacgaataagttgctgtgtcagctcaataaccgggcacgacatagactacacctcatcaaaaaactgctgataacgggattcactgaaaccaagcagcataggcttcccgggcgcgcagagcaatgggcgtttgatgattgccggctgttcaaccatgagagcagcggcggagtcggcatcggtaatcccgctgcggtggccttcatccagtttgcgccatgttgtgccgcgcgtattcagtaaaggctgccagccgagttcggcaataaaggtattaagaagagggaggtctatgccatccacacggtaatcgtgaaaacgataatcaatgccatgctcctccagccaacggcgcgcttttttgatcgtgtcgcaattcttaatgccatagagggtaatcatattgaatcctttaacgcgaaattcgaataaataatcaatagtatcgtctgcgggataataagtgtggctgttaatggttatttatccagcgctgatcggcaatcaatataacattgttgagtgaatgtgaataatgattccaaaacgttccagatgtggcttgtttataattcgtgaggaaaatcctattttgcgcacatgcaattgattgttttttaacccgatttgataaagtagtagaaaaggtattaatgttgctaaatattgcagtaagtcacataaaatttacggctacagcgccatagtaatatcatagacagcataaccagaggatatcgcaacaatcggttaaatgaacttctctctataccgctaactacgtagaatacccataataataagagaggctattatgattgaacgtgaactggggaactggggaactggggaactggggaactggggaactggggaactggggaactggggaactggggaactggggaactggaaagattttatcgaagtcatgcttcgtaaataaatgcctggaaggcaccgcgctcccataggggataagaaaaggcgactcaacgaaagtcgccttttttgtgcccgacacctcgtatcaggctggccaggagcttattccgggcgcggcttcagcgggaagcggcgacgtatcagcacgaaaaacaggggtacaaagaagatagccagaatggttgctgagatcattccccccatcacgccggttccgacagcatgttggctacccgagcctgccccggtgctggtggccatcggcaatacgccaaagataaacgccagcgaagtcatcagtatcggtcgcaggcgctggcggctggcgtacagcgtggcgtctaacagcgcgtgtcccttctgattcatttcgttggcgaattccacaatcagaatcgcgtttttcgccgagaggccgataacggtcaacagccccacctggaagtaaacatcgttttccagcccgcgcatccaggtggcgagtaacgcgccgatgaccccgagcggcacaaccagcatcaccgagaagggcaccgaccagctttcatacaatgccgccagacacaggaagacgactaatagcgaaatagcgtacagcgcaggcgcctgcgcgccggagagccgttcctggtaagacatggctgtccattccaggccaaaaccgcccggtagctgatgcaccaacgactccatgacatccatcgccgtcccggtactgacccccggcgcggcctctccgacaatttctaccgccgaatagccgttatagcgttccagacgcggcgatccggtttcccagcgcgaggtggcgaaggcggagaaggggaccatgccgccgtctttgttacggacataccaaagattaatatcgtccggcaacatacgatatttcgctgcggcctgaacatagaccttcttcacgcggccccggtccataaagtcgttgacgtagctcgatccccaggctgtttgcagggtgtcgttgatatcgtcaatcgatacgcccagcgcctgcgctttccgttggtcaatatcaatttgcagttgcgggctgtcgtccaggccgttgtggcgcacgcgggtcaaggaactgtttttcccggccagctcaatgagttgatctcgtgcggccatcagcgcgtcatggcctgctccggcgtgatcctgtaattccatatcaaaaccggcggagctgcccagaccgctaattgccggcgggctgctggcgaagacgcgagcttctttaatctggttaaatgcttttgtcgcccgctcaataatggcgaacgaggagccggtggtgggatcgcgcgcgtcccagtctttcaagcgaacaaacatacgcgcgacgttttgcccgttcccgccagggccggaaccgaccgtcgagaagaccgacataatgttgtttttctcatgggtgaagtaatagttttcaaccttttcaacgactttcagggtctgctgttgcgtagagccgctcggtagctggatagacgtagtgaacatgccccgatcttcttgcggcagaaaggaggtggggagacgcaaaaacaggaacaccatgccgccaagcaacagaacataaatcagaatccagcgcaggctgcgatgcaaaattttcgctacgcctttctcataacgttcggcattacgattgaaggtacggttaaaccagccgaaaaatccgcgttgcccgtgctgttcgcctttgtgcagcggttttaataacgttgcgcacagcgccggcgtcaggatcatggcgaccagcaccgacagcaccattgccgagacaatggtgatagaaaactgacgataaatcgccccggtggtaccgccaaagaacgccatcggtacgaataccgcagacagtaccatcgcgataccgaccagcgccccctggatttgtcccatggatttgcgcgtcgcttcacgcggcgtgagcccttcttcgctcatgatacgttcgacgttttccaccaccacgatggcatcgtcgaccaggagcccgatcgccagcaccatcgcgaacatggttaatgtgttaatactgtagccgaacgcgtaaagcacggagaaggtgcccattaatactactggcacggcgatcgtcggaatgagcgtggcgcgaaagttttgcaggaacagatacatcaccaggaaaaccagcgcgatagcttccagcaacgttttgaccacatcgataatcgaggctttgacaaaggaggtggtttcatacgcgatcttgtattccaggccgtgagggaagtactgcgccagctcgttgaggcgatccagtaccagcttcgcggtcgccatttcgttcgcgccggaggccagcttaacgccaaggccggaagccggattgccgttaaaacggctgaggtagtcatatttttccgcccccagctccacggtggcgacatcgcccagtttgacctcggaaccgtcctgattaacgcgcagggtgatatcgcgaaattgttgcggcgtttgcagcagcgactgcgcattgatggtggcgttcagcgcctgcttgtcgaccgaaggcgtaccgccaagctgcccgacggcgatttgcgcattctgcgactcaatcgcatcggtcacgtctttcgtggtcatctgaaaactattcaatttggccggatcgagccagatacgcatagagtactgtgaaccataagcgtcaatatcgcccacgccgttgacgcggctgagcgggtcctgaatattactggcgacgtagtcggcgatatcctgcttgtccatagaaccgtcggtagagacgaaagcgatggtcaaaatattggtatcgcccgttttgcgtaccgtgacgccttgatcctgtaccgcctgcggcagtttacgcatcgcggactgtaactggttttgcacctgctgaaccgcctcatcaggatcggttcccgcaatgaagctcagcgtaatggtcgcctgtccggttccgctgctttgtgatgacatgtacatcagattatcgaggcccgtcatattctgctcaataacctgggttacggtattttccagcgtttgcgccgacgctcccggataattcgcggtaatacgtacgttgggcggcgccagatcgggatattgttcaacaggtaaagaaaaaatggctaacgcccctgtcagacacaacaggatagccagcacccaggcaaaaatggggcgatcgataaaaaaattcgccattaaaggggaacctcgtgtttctacatatcgttatagatttgaactgcttcactgtagcggcaagctacgagccaaacgtggagaaataaaggagataatgtaaattatcatgcgcttttacagcatactttttgtgccaacgccggaaagcctgacatctggccttccggtgatttgccgttctttacgttaactgactctcttccttgttggaggagcgaaaactgatactgaccagcgtgccgccgccggagggttgcgaaaaattcagcgtgccgccaagccgttccgcgcgctcacgcattatattcagaccatagtgtccggcaggctcatgcggttcgccgataccaatgccattatcgcgaatataaacggtatgatcgccgtcaggcgcggtgacgcagctcacggcgatttcgctcgcgttggcgtgtttaatggcgttcaggacagcttcacgcacaatttgcaataaatgcacctgcatttgcgcatccagcgccagcgtgggtaaacggcaatccaacttgagtttagccggagtctgactctgtaaatcttccagcatctcatgcaatgcggagggtaaatcggcctgctgtaacgtcagacggaacgtggtgagtagctcgcgaagctgacggtaggcgtcgttcagcgctctggaaaaatccgccatgatgctttgcgcgccggcgttatcttctggaatggcgcgcttcaaaagcgttaattgaatacgtaaataagaaagtacctgcgccagcgaatcgtgtaactcacgggcaatcgtcgcgcgctcttccattaacaaaagttgctggaagtgtttttgcgcctgattaaagtacaaaccacgccccagcatcgtggagacgctgttcagcaacggcgtagaggcattaacgttggggctttgccagtggagttcgccatagaccgtgtcctgcatcgtcactggcagcatttgcatcggcaggtcggggctttgcgtgccttcgctaatccgccagttatcgcccacggttaactccagataccaggcggcgtcatgttcacggacaatttgcaaaatatggcgaaaacagtggacatcgatttggctggtattcagcgcctgggagcactggtataacacctccaggcggcggtgcgcttcgtgcagatcgtgcgttttttcttccaccgaggcttccagcgaacgataaagtttatgcagctcgctcgacatctgactaaacgttttcgccaacaatcccagctcattgggtaagctggtatccagcggcagcggggcgaactgaccatgttcaattcgctgactggcggtgaccagttgattcagcgggcgaacgacctgctggcgaatacgccgtagggtaaaaaagaccagcgtaaatatgccgataccgcccgccagcgatatggcgacgaccagcatgactttacgctcggcgtaatgctgtaacgccagaacgaagagatcaatttgatcgacgtaattgttgatattggactgataccagacaatgtcgccatcctgtaggcggctattcatctccagccagttggcgtgcaggcgcgcgtagcgagttttcaccgcctgcggcacataccaggcgttgagattttgcagtaccggcgagttgagcgcgtgctggaaaagttgacgatgcgcattaatctgcgggctacggctttgcagatcgtaacccagccgatagctctgcattcgtagcgaaccggcgatattgatcgcttcggcatcccgtaaactgctggtcagcgtcagtaatgcgctgccggtggacagaatagacaacagcacaatatagaaaaaagccttagccagactggccgagaccgggcgtttaaccgtcacactggtactccccgcatttagctgaaccgcaatttcatttgctttgaaataaattgatctgccacaggttctggacagatagttgtgcttcctgggcagatgaacattgccgaccccgccttcgtcagttaataacaatgctcatataaagaataaggtttttgcaaccaaaacagaaggacgccatgaatcgttttattatggccaatagccagcagtgtctgggatgccatgcctgcgaggtcgcctgcgtaatggctcacaatgatgagcgacatgttctgacgccacagcgctatcagccccgaattactgtcatcaaacatcagcgccagcgcagcgcggttacatgtcaccattgcgaagatgcgccctgcgcccgtagctgtccgaacggcgcgatcgcgcatattaacgacagcgtgcaggtcaatgcgcagaagtgcatcggctgtaagtcctgcgtcgtcgcctgcccattcggcaccatgcagatggtattgacgcccgtcgcgccaaaccagttcaaagccagcgcgcataaatgcgatctgtgtcagggacgtgaacagggtccggcctgtgtggaaaattgcccggcggatgcgctgcaactggtcaccgaagactcgttgacccgtctggctaaaacgcgacggctgcgtaccgcccggcaggagattcgcccctggcataccgtggatacacaacacagtgggacagcatgcagcaaagtcgagcgtatgcaggcgacgccgccgcgcggcgaaccggataaactggcgattgaagcgcgtaaaaccacctttgaggaaatttatctgccgtttcgcgccgcgcaggcggagcgtgaagcggcccgctgcctcacatgcggggaacacagtatctgcgaatggacctgtccgctgcataaccatattccccagtggatcgaactggtgaaagccggcgatattgatgcggcggtagagctttcccaccagaccaactgtctgccggaaattaccgggcgcgtctgtccgcaggatcggctatgcgaaggcgcgtgtacactccgcgatgagtatggcgcggttaccatcggcaacattgagcgctatatctccgatcgcgctctgagcaaaggctggcgtcccgacctgtcggacgtacagaagagcgataagcgcgtggcgattatcggcgcggggccggcaggtcttgcctgcgctgacgtgctggcgcgccgtcgggaaatcttcagcgcgatggggattcgtttcgaacttaactgcgaagtagggaaagatatttctctggagacgctgctggagagttatgacgccgtctttgtcggggtaggaacctatcgttccatgaaggctgatttaccgaatgaagacgcgccgggggtatatgatgcgttgccattcctcatcgccaataccaaacaggtgatggggcttccggcgttgcctgacgagccgtttattgatactgcgggccttaacgtggttgtgctgggcggcggtgacaccgcaatggactgcgtacgtacggcgttgcgtcatggcgctgccaacgtcacctgcgcttatcgccgcgatgaggccaatatgccagggtcgaaaaaagaggtgaaaaacgcgcgggaagagggcgcgaactttgaatttaacgttcagccagttgagttggtgctggatacgcacgggcgcgccagcggtattcgctttttgcgtacgcggcttggcgaaccggatggtcaggggcgacgccgtccggtacctgtaccggacagcgagttcgtgatgccggcggatgcggtcattatggcgtttggttttcatccgcatggtatgtcgtggctggaatcgcatggcgtgaaggtggataactggggacgtattgccgccagcgtcgagagcgagtttcgttaccagacgtccaacccgaaaattttcgctggcggcgatgcggtgcgcggcgccgatctggtggtgacggcgatggcagaaggccgacatgccgcgcaggggatactcgactggttagctaaataagcgtatttgtaggccggttaaggcctggaacggttaaatgatttagtgataaaaaatcttaaacttattggctaaccttactccgtttgcagaaatgttgacgctcgcagggctggacgccctgcgataaacattttcccgctgggtcgatgtttaacaggcctgataaggtcaatcttagtattgaaaatagagtgtaaattgaaggaagggacgctatcagaatcccttcttagagcctatcccattagggctattttacgtgccattttggacctgggcagtgctcgccaaaacgcgttagcgttttgaacgccgcttgcggcggcccgaaggacgagcgtagcgagtcaaacctcacatactacgtgtacgctccggtttttgcgcgctgtccgtgtccaaactggctgcgccaataacgtctggtgggataggctcttaatttttattttaaggaaccatatatctggtcaacaatccagccatacgtcgccgcaggtaataatccactgacaaaaacattcgggttcactttaggatttgctaccggcgagtgcggcctgttacctaaaataacaatcgccatatgattaaccggatcgatagacgtcagcgttccggtccatccggtatgtccatacgtttgcggactggctaataccccgaacgttggggtcattgaggcgttgccgttaacgcgccaccccagaccaaaggtagcatcttctggcgagcggcgagtaaactgcgcaaccgttttgttgtcgaatagcttcacgttaccgtagccgcccccattgagcatgacttgcattaacacagccatatcatgggtgtcagaaaacagtccggcgtgtcctgaaacgccgcccattgagtaccaggctttttcgtcatgcacctggccccatagtgtattggtgcgaatattggggaaatgaatcacgccgtcacgcgtgttgccgtgtagttccgttgcggcgatttgcggcggcgtgaagcctttcatcagcgggttaaagacggtatgttttaatccgagcggtttataaatggtggtttcgacgtagcgatctaatggcattgccgttatcgattcaatgataaaaccaagaatcatataatccacgtcgctgtagatatgcttcgacccaggttgatattccagcggtgtctttttaatcatctccagagtagtgcttttactctgtgaaaataatttaccggcgacgtttttattgggatattgtgggtcggcaggaaagcccgcgacgtgatgaagaatatcaataatgcggagtttatctttgccttttattttatccccaggcatatccttaaagccggggatatattttgataccaaatcattgacatctatttttccttcatacaccagtttttgcaatgcaaagttagtggcatacatttttgtgtttgaagccaggtcatacatcgtgttagtggtcgcccgaatgggatgggctaacagcgtggaaccgtcatattttttggcatagccccaggctttttgtagaacaatatgattatcttttatcaccagaagattgatgctgggatatccggcatcaatttgattttgaatccagccatcaagtcggtgaagtttttggctatcaaaccccacctgatcagggctcgcggtggtcaataccggatactcaacggcaaaagctgaaagggaaaacgtcagtagaaccgtcgcaacgagagtaaatttcatgatgattccctcagtctcactccggccgtcaaatcatatcgcgagcatggactctgcggcccggagaagcagaatgtggtcatggcagtgacagaaaaatatggctgtacatccgttcagtcggcattaaggattaacccttcagcagacaaaaccgacctcacggcgtaatattaatgctctttttacaccctggagccagcatgtcgcaaaccattacgcttattaaggataaaattctttctgataattattttactctgcgcaacattacctatgacctgacccgtcgtaatggcgaggttatccgtcacaagcgtgaggtttacgatcgcgggaatggcgcaaccattctgctttacaactcaactaaaaaaaccgtggttctggttcgccagtttcgcgtggcgacatgggtcaatggtaatcaagacggtatgttaattgaaacctgcgctggcctgcttgataacgacgagccggaggtctgtatccgtaaagaggccattgaagagacagggtatgacgttggtgaggtacgcaagatatttgagctgtatatgtcgccaggcggcgtcacggagctgattcatttcttcattgccgaatatcatgatagcgagcgtgccagcatcggcggcggcgtggaggacgaagagattgaggtgcttgaactaccgttttcccgggcgctggaaatggtgcgctcaggcgagattcgggacggtaagaccgtgttattgcttaactatttacagacgtctcatctaatggactgaaaaaaaagaaatatatttctttacacaaaaaagaccaatccgataaatctgattgagaaccctgaggcgcgcaaggaagataccgcctgagctgtgttgttctgaatctggggttgttccgttcatgcgctaccgcgttattcttttttgtctgtttggcctgttgccggtccagctactgtgggctgcgccagcgcaacggactttttccgactggcaggtcacctgcaataaccaaaatttttgcgtagcgcgcaatactggcgaacatcatgggctggtgatgacattaagccgcagcgccggggcgcgtaccgatgcggtactgcgtatcgaccgcggcggtttggcgccgcccgacgctaaagaagccgcaattgcgcctcgcttattgctggatggcaaaccgctttcgttcaacagttcacactggcgcgtgtcgccctggcatctcatgaccggcgatcctgccaccatcaccgcatttttacagacgattcaggatgcgcaggccatcaccttaaaaaacggcgttcagacgctttcgctggcgggattaaaagcggcattactgtttatcgacgcgcaacaaaaacgtgtgggcagcgaaaccgcctggattgaaaaaggaaacgaaccgccgctcagcgtgcccccggcaccggcattaaaggggatcgccgttattaatccaacgcccgtaccgctgagtgaggaagaacgcgacgatctgctggactacgccgcatggcgggtaaacggcattcgttgttcgcttgacccgctgcgtcgcgagacgcaggtcagcgcgttgacggatgataaagcgttattgattgttaactgcgaagccggcgcctataacactattgatctcgcctgggtagtttcacgcaaaaaaacgctcgtctcgcgcgccgtacgtttgcggctgccgtttaatcgcggcgtcgaaagtaatgacatggagttgatgaacgccttctttgacgagaaaacgcgcgagctggtgacgttggcgaaagggcgggggttaaccgactgtggtatccagacgcgctggcgctatgatggcgatcgttttcgtctggtacgttatgccgaagaaccgagctgcgatagctggcacgggccggatgcctggcctacgctgtggatcacgcgttgaatcctggttgttatccccttttcagaatagggatacacctattgaggtttcatttatggtatagagattgctacgttacggtaggattgttactttacccgatagcctcaccacagcaggaaatagtatgaaaataaataatggccccgtattatgcccccattgtggctgcctgagcgcttattatgaaatagatcggctggcggcgataagagaaaaagtgaataaagaaggcggatcagcggcgtgggattcaacattgcaggcgcataaaaaaaaggccttttgcctgatgtgccataaatccattgatgaggtcgtcatcgggcagtcagatgcgcctgagtctacgaagtaattttgcacagcctacagaacaggtctgcagactgtgcaaagtctgtgttgctaacgcccgccttagcctttgatgttcagcacccggcgggctttttccacaatattttccacggtaaagccaaaatacgggaacagtttgtcagccggggcggattcaccgtatcccgtcatgccgataattgcgccttttaggccaacatatttataccagtagtcggctataccggcctccaccgcgacgcgggcggttacgtgcgccggtagcactgattcgcgatatgcctcgtcctgcgcatcgaaaatatccgttgaaggcaacgacaccacccgaacgttatgcccctcgccagtcaatttttccgccgcctggagggtaatttccatttccgatccggtagcgatcagaatgatatccggcttgccgccgctatctttcagaatataaccgccgcgggcaatcgctttcacctgttccggcgtgcgttccacctgcgccagattctgccgcgagagaatcaacgccgtcggcccgtgctgacgttcaatggccagcttccaaccgactgccgcctcaacctgatcgcagggacgccaggtgctgaagttaggcgttaagcgcaggctcgccagttgttccatggcctggtgcgtcgggccatcttcgcccaaaccgatggagtcgtgggtatagaccataatctgccgggctttcattaaggccgccatacgcgccgcgttacgcgcatattcgacaaacatcagaaacgtggcggtatacggtacaaagccgccgtggtgggcgatgccgttggcaatggcggtcatgccgaattcgcgcacgccatagtggatgtaattacctgccggatcctctttcaacgaggtcaaacctttccagatagtcaggttgctcggcgccagatccgccgatccgcccaacagttccggcaacaggggaccataggcattgagcgtattttgcgatgctttacgggtggcgattttggccggattagcctgcaagtcgttaataaatttttgcgtggcggattcccatgcctccggcaatccgccgctcatccggcgggtaaactccgcggccagctcaggataagccttctcataagcagcaaacttttcctgccactgctgctgcgctttctcgcctttttcacggccatcccacgcgcggtaaatctcttttgggatctcaaacgccggatgatgccatcccagcttctggcgggtcagcgccacctcttcttcgcccagcgccgcgccgtgcgactcctccttcccggctttattcggcgagccaaaacctatcaccgtccgacagataattagcgaaggtttatcttttacgctctgggcttccagaatggcttttttcaccgcctccggagcgtgcccgtcaatgtcatgcacgacatgccagtggtaggcttcaaaacgtttggctgtatcgtcggtaaaccagccttcggtttcgccatcaatggagatgccgttgtgatcgtaaaagccgatcagtttgcccagtcccagcgtaccagccagcgaacacacctcatgcgagatcccctccatcagacagccgtcgcccataaagacataggtgtagtggtcgacaatctcatggtccggccggttgaactgtgcgcctaacgtacgctcggcaatcgccagcccgacggcattcgccagcccctggcccagcggcccggtggtggtttcaacgccaggcgtatagccaatctccgggtgaccaggcgttttagagtgcagttgacggaagttttttagctcctccagcggcaggtcatacccggttaaatgcagcagactatagagcagcatggaggcgtgactgttggaaaggataaaacgatcacggtcataccaggtcggatcggtggggttatgtttaagaaaatcgttccatagcacttcagcgatatccgccatccccatcggcgcgccggggtgcccggaattggctttttgaacggcatccatgctcagcgcacgaatcgcattggcaaggtctttacgggacataaatcactccatgcaaggtttatagtttggcggcaagcaggtcttccagtttgcgctggtcaacggcgaaaaggcggataccttccgacagcttctctacggccatcgcgtcctgattatgttcccagcggaactccgcttccgtcattggcgtaggacggtggaacatctgcgaggaaggcaccagtttacggatcaccggttcttctttttctttcagctctttaagcaggttaggggagatagtcagtcgatcgcagccggttagcgcgaggatttgctcagtacggcggaaacttgcacccatcacgatggtttcatagcgatgctgtttaaagtaatcgtagatattgcgtaccgatttcacgccgggatcttcctccacgacatacggctccagcggactacgcgcctgataccagtcgtaaattcggcccacgaacggagagattaaatagacgcccgcttcggcgcaggcgcgcgcctgggcaaaagagaacaacaacgtcaggttgcaattaatgccttctttttcgagctgttcggcggcgcgaataccttcccaggtcgcggcgagcttgatcagaatgcgtgatttatcaacatcctgctgctggtagagatccaccagatggcgtgctttctcgatacttttttctttatcgaacgataaccgcacgtcgacttcagtggagacgcgaccgggaatacttttcagtatttccgcgccaaaattaaccgccagtttatcgctggctgccgcaacctgctgttcctgcgtaccgccgtgtttttttccccaggcaatcgcatcctcaatcaaatgaccatactgctcaagcccggcggcttttaacagtaaagagggatttgtcgtggcatcctgcggctggtagtggcggatggactcgatgtcgccgctgtcggcgacgacggtagtgaattgtttgatgccgtctagctggttcataggaaatactccttgaaaagtaaagtgttagatgagtgtgttgattcacacttctgaaagattgatacactacataaccaaaaagcatagcagacaggcatggtattgctggtataagcaggtaacatggctgttataagttgataacaaactcttgcgccgcgtcgtgatagtttgcagaccttcaaagtttgtgttgcgcagtacggtgataatgtgcggcgcaccaggccgcgtcactttttgaacgatacgtgaaaggaacaacaaaatggatgagcagttaaaacaaagcgcccttgatttccacgaatttccggtacccggtaaaattcaggtttctccgactaagccccttgccacccaacgcgatctggcgttggcttactcgccaggcgtggcggcgccctgcctggaaatcgaaaaagatccgctggcagcctacaaatacaccgcgcgcggcaaccttgtcgcggtcatttccaacggtacagcggtgctggggttaggcaacatcggcgcgctggccggcaagccggtcatggaaggcaaaggcgttctgtttaaaaaattcgccggcatcgatgtgtttgacattgaagtcgatgagcttgatccggacaaatttatcaatgtggtcgcagcgctggagccgacctttggcggcattaacctcgaagacattaaagcgccggaatgtttctatattgagcagaaactgcgcgagcgcatgaacatcccggttttccatgacgatcagcacggaacggcgatcatcagtacggccgccattcttaatggcctgcgagtcgtagagaaaaatatttccgacgtgcggatggtcgtctccggcgcaggggcggcggcaatcgcttgtatgaacctgctggtcgcgttggggatgcagaagcacaacatcgtggtgtgcgactctaagggcgttatttacaaaggccgtgagccgaatatggcggagaccaaagcggcctatgcggtagacgacagcggcaagcgcacgctggatgaggtcattgacggcgcggatattttcctcggctgttcaggcccgaaagtgctgactcaggagatggtgaagaaaatggcccgcgcgccaatgattctggcgctggctaacccggaaccggaaattctgccgccgctggcgaaagaagtgcgtccggacgccatcatctgtaccggtcgttccgactatccgaaccaggtgaacaacgtattgtgcttcccgtttatcttccgcggcgcactggacgtcggcgcgacggcgatcaacgaagagatgaaactggcggcggtccgtgcgattgccgagctggcgcacgccgaacagagcgaagtggtggcctcggcctatggcgatcaggacctgagctttgggccggaatacattattccgaaaccgtttgacccgcgtctgattgtcaaaatcgctccggcggtcgcgaaagcggcaatggattccggcgtggcgacgcgcccgattgctgactttgatgcctatatcgataaactgaccgagtttgtctacaaaactaacctgttcatgaagccgatcttctcgcaggcacgcaaagatccgaagcgcgtagtgctgccggaaggggaagaggcgcgcgtgctgcacgcaacccaggagttgataaccctggggctggcgaagcccatcctgatcgggcgtccgagcgtgatcgaaatgcgtatccagaaactggggttacagatcaaagcgggcgttgatttcgagatcgtgaataatgaatccgatccgcgcttcaaagagtactggagcgagtattaccagatcatgaagcgtcgcggggtaactcaggaacaggcgcagcgtgcgatgatcggcaaccatacggccattggcgcgatcatggtgcagcgtggagaagcggatgcgatgatctgcggcaccatcggcgactaccatgagcatttcagcgtcgtgaaagccgtctttggctaccgtgacggcgtgcatacggcaggggcgatgaacgccttactgctgccaagcggcaacacttttatcgccgatacttatgttaacgaagatcccacgccggaacagttggcggagatcgccgtaatggcggcggaaaccgttcgccgctttggtattgagccgaaagtcgcgctgttgtcgcactctaactttggttcctcaaattcgctgtccgccagcaaaatgcgcgaaacccttgagcgggtacgcgaacgagcgcccgatctgatgattgacggtgagatgcacggtgatgcggcgttggtggaaagtattcgtaatgaccggatgccggatagtccgctgaagggagccgccaatattctggtgatgccgaatatggaagccgcccgcattagttacaacttactccgcgtctccagttccgaaggcgtcacggtcggcccggtcctgatgggcgtgtctaaaccggtacatgtattaacgccgatcgcctctgtacgccgtatcgtgaatatggtggcgttagcggtagttgaagcgcaaaccacgccgctttaataacgcattactctctcttctggcgcaggttctcctgcgcttttttgtctatggaaaacccccagctaggctgggggttccggaaagctttcagctttaagccagttattaaaaccccttttgatttgttaaaacatcttgcggtctggcaactgcaaaagttcaacaagaaatcaaaagggggtccaatgagggacgaaaagagcttagcgcacacccgatggaactgtaaatatcacatagttttcgcgcccaaataccgaagacaagcgttctatggagagaagcgtagggcagtaggcagcatattaagaaaattgtgtgaatggaaaaacgtacgaattctggaagcagaatgttgtgcagatcatatttacatgcttctggagatcccgccgaagatgagtgtgtcgagtttcatgggatatctgaagggtaaaagtagtctgatgctttacgagcagtttggggatctaaaattcaaatacaggaacagggagttctggtgcagagggtactatgtcgatacggtgggtaagaatacggcgaagatacaggactacataaagcaccagcttgaagaggataaaatgggtgagcaattatcgatcccgtatccgggcagcccgtttacgggccgtaagtaacgaagtttgatgcaaatgtcagatcgtatgcgcctgttagggcgcggctggtaagagagccttacaggcgcatcagaaaaacctccggctatgccggaggatatttattttatgcgccgctgggcttcgccatggtatgaaaggctcgggtggggatattctggaacctattgcgttacccctacttatttcactgaatctgtactatgcacaaatcgagtgatacgcattatttttatcaataatagtaatacaaagaatagccggtgggtatttattgcggaacaagcttaaattcagaatgacgcctgaaaatgtgatgcaccacgatatttatcgttaacaccttcgacagaagtcccttttattttctttctcttagtgatctacctcaccttttacatcaccttgccgaattttgttatttactccgacaaaaaattgccacgatgacggcagtttcagtggagacggtgagcaatgaataaagaacgcattattcaggaatttgtgccgggcaaacaggtcacgctggcgcatctcattgcgcaccctggtgaagaactggcgaaaaagatcggcgttcccgatgctggcgcgattggcattatgaccttaacgccgggggaaacggccatgatcgctggcgatttagcgatgaaggctgcggatgtacacatcggttttctcgacagatttagcggcgcgctggtgatttatggcaccgtcggcgcagtagaagaagcgctattacagacggtcagcgggctggggcgattattaaacttcaccctgtgtgagttaacaaaaagttaattggtggcggtaatgaaacgtattgcttttgtcggcgcggtcggcgccggaaagacaacgctttttaacgcgttacggggaaattattccctcgccagaaaaacgcaggccgtggaatttaatgatcatggcgatatcgatacgccgggtgaatattttagccatccccgttggtatcacgccttaattaccacgttgcaggatgtggacacgctgatttatgtccacgcggcaaacgataaagaaagtcgcttacctgccgggttattggatgttggaacccgtaaacgacatatcgccgttatcagcaaaacggacatgccggatgccgacgtcgccgctacgcggcagttgctttgcgagattggattccgggagccgattttcgagctcaacggccacgacccgcaaagcgtgcggcagttggtggattatctggcggctctcagtgaacaggaggaagaggcaggtgaaaaaacttatcacagctaacgatattcgtgcggcccacgcccgcggcgaacaggcgatgtcggtagtgctgcgcgccagcattattaccccggaggctcgcgaagtggcggaactactgggcttcacgattaccgaatgcgacgagtccgtcccggcatccacatcggcgcaggcgtgtaaaagcgaaagccagcgcattcgggaagccatcatcgcgcagcgcccggaagggcagtttactgaaagcctggtggcgcagttgatggaaaaagtgctcaaggaaaagcagtcgctggaactggggacgatgcagccgagctttacctccgtcacgggtaaaggcggcgtgaaagtcattgacggcagcagcgtgaaatttggccgcttcgacggcgccgaaccgcactgcgtcggcttaaccgatctggttacagagcaggatggcagcagcatggccgccgggtttatgcagtgggacaacgcctttttcccgtggacgctgaactacgacgaaatcgacatggtgctggagggtgaactgcacgtacgccatgaaggcgaaaccatgattgccaaagccggagatgtcatgttcatccctaaaggctccagcattgaatttggcacgccaacgtccgtgcgctttctgtacgtcgcctggcctgcaaactggcaatccgtatgaacgatttcatcaccgaaacgtggctcagagcgaatcatacgctcagcgaaggatcggaaatccatctgcccgctgacgcacgactgacgccctcggcccgggaactgctggaaagtcgtcgcctgcgcattaagtttctggatcagcaaggccggctgtttgtcgatgatgacgaacagcagccggtacatggcttaaccagtagcgatacgcacccacaggcctgctgtgaactgtgccgccagccggtggtgaaaaagcccgatacgctgacccatctgacggcggacaaaatggtcgccaaaagcgacccgcgcctcggctttcgcgccgcgctcgacagcgccatcgcgctgaccgtgtggctacaaatcgaactggcggaaccctggcagccgtggcttttcgatatccgctcgcggctgggcaacattatgcgcgccgacgctatagatgaaccgctggcggcgcagtctatcgtcgggctgaacgaggatgagctgcatcggctttcccaccagccgctgcgctatctcgaccacgatcacctggtgccggaggccagccacggtcgcgatgcggcgctgcttaatctgctgcgaaccaaagtccgcgaaacggaaaccctcgccgcacaagtgtttattacccgtagttttgaggtcttgcgcccggacattttacaggcgctaaaccgtctctccagcacggtttacgtgatgatgattttgagcgtggcgaaacatccgctgacggtcgcccaaattcaacaacggttgggagagaagccatgatcattgaacgcgcccgcgaactggcggtacgcgcccccgccagagtcgtctttcccgatgcgctggacgaacgcgtgctgaaagcggcgcattacctgcaacagtgcggtctggctcgccccgttctggtcgccagtccgtttgcgctgcgtcagtttgccctgagtcatcgtatggcgatggatggcattcaggtcatcgacccacacagcaacctgagtatgcgccagcgttttgcgcaacgctggcttgcccgtgccggagaaaaaacgccgccggacgcagtggaaaagcttagcgacccgctaatgttcgctgccgccatggtgagcgccggtgaggctgatgtgtgtatcgcaggcaacctgtcgtcaacggcgaacgtgctgcgcgcagggctgcgggtgattggcctgcaacccgggtgcaaaacattatcgtctattttcctgatgctgccgcagtatgccggcccggcattagggttcgccgattgcagcgtagtgccgcagccgacggcggcgcagctggcggatatcgctatcgccagcgccgacacctggcgggccattaccggcgaagagccgcgcgtggcgatgctgtcattttcaagcaacggcagcgcccgtcaccccaatgttgccaacgtgcagcaggcgacagagttcgttcgcgaacgtgcgccgcaactgcttgtggacggtgaattgcagtttgacgccgctttcgtaccggaggtcgccgcgcaaaaagcgcctgacagcccgctgcaaggccgcgccaacgtgatgattttcccgtcgctggaggcgggcaatattggctacaaaatcgctcagcgtctgggaggctatcgcgctgttgggccgctaattcaggggcttgccgcgccgcttcacgacctctcccgaggctgtagcgtgcaggaaattatcgaactggcgttggtggcagccgtgccgcgccaggctgacgtgagccgcgaacgcagcttacacacactggttgaatgaacggtcccgttctggacccctttaatgagaggaaaacacgatggaagcattaggaatgattgaaacccggggcctagttgcgctgattgaggcctcagatgcgatggtaaaagccgcacgcgtgaagctggtcggtgtgaagcagattggcggtggcctgtgtacggccatggtgcgtggcgacgtggcggcgtgcaaagccgcaaccgatgctggcgccgctgcggcgcagcgcattggcgagctggtctctgtacacgtgattccacgcccgcacggcgatctggaagaagtgttcccgatcagcttcaaaggcgcagcaacatttgatggtaggccggataagacgcgcagcggcgccatccggcatgaatgcgcgccattgcctgatagtgcgcagattcaaggcctacgacccaacgggcaatccatggaggcggatatgaaactggcagtcgtcacaggacaaatcgtatgtaccgtccgccatcagggactggcgcatgacaaattgctgatggtggaaatgatcgatgcccagggcaaccccgacgggcagtgtgccgtcgctatcgacagtatcggggcgggaaccggagagtgggtactgctggtcagcggcagttccgcgcgccaggcgcatcgcagcgaattatcaccggtcgatctgtgcgtcattggcatcgtcgatgaagtggtggctggcgggaaagtggttttccataaataggactgaacatcatgaatcaacaggatattgaacaggtggtgaaagcggtgctgctgaaaatgaaagacagcagccagccggccagcactgttcatgagatgggcgtttttgcctccctggatgacgaagtggcggcagcaaaacgggcccagcaggggctgaagagcgtggcgatgcgccagcttgccattcatgccattcgcgaggcgggcgaaaaacacgcccgagaattagcggaacttgccgtcagcgaaaccggcatgggacgcgttgacgataaatttgccaaaaacgtggcgcaggcgcgcggcacgccgggcgtcgagtgtttatctccgcaggtgctgaccggcgataacggcctgacattgattgaaaatgcgccgtggggcgtggtggcctcggtcacgccgtccaccaatccggcggcgacggtgatcaataacgccatcagcctgattgccgcaggcaacagcgtcgtgtttgccccgcatccggcggcgaaaaaggtctctcagcgggcaatcaccctcctcaatcaggcggtggtcgccgccggcggcccggaaaatctgctggtcaccgtggcgaacccggatatcgaaaccgcccagcggctgttcaagtaccccggtattggcctgctggtggtgaccggcggcgaagcggtggtggacgcggcgcgcaaacatactaataaacgcctgatcgccgccggtgccggcaatcccccggtggtggtggatgagaccgccgacctgccgcgcgccgcacaatccatcgtcaaaggcgcgtcgtttgataacaacatcatctgtgccgacgaaaaagtgctgattgtggtggatagcgtcgccgacgagctgatgcgtctgatggaaggtcagcacgcggtgaaactgactgccgctcaggccgaacagctccagccggtgctgctgaagaatattgatgagcgcggcaaaggcaccgtcagccgtgactgggtcggtcgtgacgcgggcaaaatcgccgcagccattggcctgaacgtcccggatcaaacgcgcctgctatttgtggaaacgccagctaaccatccgtttgccgtcactgaaatgatgatgccggtactgccggtggtgcgggtcgccaacgtcgaagatgccatcgccctggcggtacaacttgaaggcggttgccaccatacggcggcgatgcactcgcgcaatatcgacaacatgaaccagatggcgaacgccatcgacaccagcattttcgtcaaaaacgggccgtgcattgccgggcttggattgggcggagaaggctggaccaccatgactatcactacgccaaccggcgaaggggtgaccagcgcgcgtacctttgtgcggctgcgtcgatgcgtgctggtggatgcgtttcgcattgtataagggatgactcatggcgcacgacgaacaactctggctcaccccaagactgcaaaaagcggcggccctgtgtaaccagacgcccgccgccagcgacacaccgctgtggctgggcgtcgatttgggcacctgcgacgtggtgtcgatggtggtcgacggcaacgcccagccggtggcggtgtgccttgactgggccgacgttgtgcgtgacggcatcgtctgggatttcttcggcgccgtcaccctcgtgcgccgccatctcgacacccttgaacagcagctcggctgccgctttacccacgcggcgacctcgttcccaccgggcaccgacccgcgtatttcgatcaacgtgctggagtctgctgggttagaagtcagccacgtactggatgaaccgacggcggtggcggatctgctggcgcttgataatgcaggcgtggtggatattggcggcggcactaccggcattgccatcgtcaaacagggcaaggtgacttactccgccgatgaagccactggcgggcaccatatctccctgacgctggcgggcaaccgccgtattcccctagaagaggcggaacagtacaagcgcagcaatgcgcaggagatttggccggtagtgaagccggtgtacgaaaagatggcggagatcgttgctcgccacattgaagggcaaggaattgctgatttatggctggcgggcggttcctgtatgcagccgggcgtggaggcgttatttcgccagcgtttcccggagttacaggtgcatttaccgcagcacagcctgtttatgaccccgctggcgatagctaacagcgggagagcgaaagcggagggactctatgcaagctgaactacagacggcgctgtttcaggcattcaacaccctgaatctgcaacgggtgaaaacgttcagcgtaccgccggtcacgctgtgcgggcttggggcgctcggcgcctgcgggcaggaagcgcaagcgcggggcgtaagccatttgtttgtgatggtcgacagcttcctgcatcaggcgggaatgaccgcgccgctggcacgcagcctggcgatgaaaggcgtggcgatgacggtctggccgtgtccgccaggcgagccgtgcatcaccgatgtctgcgcggcggtggcgcaactgcgtgaggcggcgtgcgacggcgtagtggcctttggcggcggttcggtgttggacgcggcgaaagcggtcgccctgctggtgactaaccctgaccagacgctgagcgccatgaccgagcgcagtacattacgcccgcgtctgccgctgattgcggtgccgaccaccgccggaaccggttcagaaaccaccaacgtgacggtgattatcgacgcggtcagcgggcgcaagcaggtgctggcacacgcgtcactaatgccggatgtggcgattcttgatgctgccgtgaccgaaggcgttccgccaaatgtgacggcgatgaccggtatcgatgcgctgacgcatgcgattgaggcctacagcgcgctcaacgccacgccgtttaccgacagcctggcgattggcgcgatagcgatgattggcaaatcgctgccgaaggccgtcggctatgggcaggatctggcggcgcgtgaaaatatgttgctggcctcctgtatggcgggaatggccttttccagcgccggtctggggctgtgtcatgcgatggcgcaccagccaggggcggcgctgcatattccgcacggccaggccaacgccatgctgctgccgacagtcatgggctttaaccggatggtatgccgcgagcgcttcagtcaaatcggtcgggcgttaaccaataagaaatcggacgatcgcgatgcgattgcggcggtgtgcgagctgattgccgaagtggggcagagcaaacggctggctgacgctggcgccaaacccgaacactacagcgcgtgggcgcaagccgcgctggaggatatttgtctgcgcagtaacccacgcaccgccacacaggcacagattatcgacctgtacgcggctgccgggtaatgctgtaggccggataaggtgctcgcatcgccatccggcaataacacggcgttaatgccggaggcgacgtaaacgtcttatccggcttacaaatcaaaaatgacagggagtaggggctatgggaattaacgaaatcatcatgtacatcatgatgttctttatgctgattgccgccgtggacaggatcctgtcgcagttcggcgggtcggcgcgcttcctcggtaaatttggcaagagtatcgaggagtctggcggccagtttgaagagggctttatggcgatgggcgcgttgggactggcgatggttggtatgaccgcgctggcgccggtgctggcgcatgtactggggccggttattatcccggtatacgaaatgctgggcgcgaacccatccatgttcgcgggtacgctactggcttgtgatatgggcggattcttcctcgccaaagagctggccggcggtgatgtcgcggcgtggctatactcagggttaatacttgggtcgatgatggggccgaccattgtgttctccattccggtggcgctcggcattatcgaaccgtctgaccgccgctacctggcgcttggcgtactggcgggtatcgtcaccattcccattggctgcattgcgggggggttgatcgccatgtactcaggtgtgcagatcaatggtcagccagtggagtttaccttcgcgctgatcctgatgaacatgatcccggtattgatcgtcgcggtgctggtagcgctggggctgaagttcatcccggaaaaaatgatcaacggtttccagattttcgccaaatttctggtggcgctgatcaccatcggtctggcggctgcggtggttaaattcctgttgggctgggagttgattccggggctcgacccgatctttatggcgccaggcgacaaacccggcgaagtgatgcgcgccattgaagtgatcggctctatctcctgcgtgctgctcggcgcgtatccgatggtgctgttactgacccgctggtttgaaaaaccgttgatgaatgtcggtaagctgctgaacgtaaataatattgcggcggcaggcatggtagcgaccctggcgaacaatatccccatgttcggcatgatgaagcagatggatacccgcggcaaagtgattaactgcgcatttgccgtctctgcggcgttcgcgctggtcgaccatttaggcttcgccgctgccaacatgaacgccatgatcttcccgatgattgtcggcaagctgatcggcggcgtgacggcgattggcgtggcgatgatgctggtgccgaaagatgacgccgcccaggtgaaaaccgaagcggaggcgcaatcgtgaacactcgccagctactgagcgtcggtatcgatatcggcaccaccaccacgcaggtgatcttctcgcgcctggagttggttaaccgtgcggcggtgtcgcaggtgccgcgctacgaattcatcaaacgcgacattagctggcaaagcccggtcttctttacgcccgtggataagcagggcggtctgaaagaggcagaacttaaagcgctgattctggctcagtatcaggccgcaggcatcgcgcctgaatcggtggactcaggggctatcattatcaccggcgaaagcgccaaaacccgcaacgcccgtccggcggtcatggcgctctcgcagtcgctgggcgactttgtggtcgccagcgccgggccgcatctggaatcggtcattgccggttacggcgccggggcgcaaagcctgtctgagcagcggatgtgccgggtgctgaatattgatatcggcggcggcacgtctaactacgcgctgtttgacgcgggaaaagtcagcggcaccgcctgccttaacgtcggtggtcgcctgctggaaaccgacgctcaggggcgcgtggtttatgcccatcagccggggcagatgattatcgatgaggtgttcggttcgggtactgatgctcgcgccttagctgccgcacagttggggcaggtggcgcggcggatggcggatctcatcgtcgaggttatcactggcgcgctctcgccgctggcgcaatcgctgatgcaaaccgggctgctgcccgccgatattacgccggaggtgatcaccctttccggtggagtaggtgaatgctaccgcaaccaacctgccgatccgttctgcttttctgatatcgggccgctgctggcgaccgcgctgcatgagcacccgcgtctgcgcgagatgaacgtgcagtttccggcgcaaaccgtacgcgccacggtgattggcgcgggggcccatacgctctcgctttccggcagtactatctggctggaagacgtccaactgccgctgcgcaacctgccggtggcgatcccgcaggatgacgccgatttggtgaacgcctggcggcaggcgcttctccagcttgatctcgacccgcaaaccgacgcttacgtgctggcgcttccctccacgcttccggtgcgttacgccgcattactcacggtcatcaacgcgctgacggcttttgtcgcgcgttatcccaatccacatcccctgctggtggtggccgagcaggattttggtaaagcgctgggcatgttattgcgcccacagttaccgcaacttccgctggcggtcatcgatgaggtggtcgtgcgggcgggagactatatcgacattggtacgcctctttttggcggatcggttgtgccggtgacggtgaaatcactcgcatttccttcctgagggaacgacttatgaaactaaagaccacattgttcggcaatgtttatcagtttaaggatgtaaaagaggtactggctaaagccaacgaactgcgttcgggggatgtgctggccggggttgccgcggcaagttcgcaggagcgcgtagcggcaaaacaggtactgtcggaaatgacggtggcggatatccgcaacaatccggtgattgcctatgaagaggactgcgtgacgcgcctgattcaggatgacgtcaacgaaacggcctataatcggattaaaaactggagcatcagcgaactgcgcgaatacgtactgagcgatgaaacctccgtggacgacatcgcgtttacccgcaaaggcctgacctccgaagtggtggcggcagtggcgaaaatctgctccaacgccgacctgatctacggcggtaagaaaatgccggtgatcaaaaaagccaataccaccatcgatattccgggcacctttagctgccgtttgcagccgaacgatacccgtgacgatgtgcagagtatcgccgcgcaaatctacgaagggctttctttcggcgcaggcgatgcggtgatcggcgttaacccggtgaccgatgacgtggagaacctgacccgcgtgctcgacaccgtttacggcgttatcgataaattcaatattccgacccagggctgcgtgctggcgcacgtcaccacccagattgaagcgattcgtcgcggcgcgccaggcggactgattttccagagcatttgcggcagcgagaagggcttaaaagagttcggtgtcgagctggcaatgctcgacgaagcgcgggcagtgggggcggagttcaaccgcatcgccggggaaaactgcctgtactttgaaaccggacagggctcggcgctgtcggctggtgcgaactttggtgccgaccaggtgacgatggaagcgcgtaactacgggctggctcgctactacgatccgttcctggtgaacaccgtggtgggctttatcgggccggagtatctctacaacgacaggcagattatccgcgccggtctcgaagatcactttatgggcaagctgagcggcatctcgatgggctgcgactgctgctataccaaccatgccgacgccgaccagaaccttaacgaaaacctgatgattctgctcgccactgccggctgtaactacatcatggggatgccgctcggcgacgacatcatgctcaactaccagactaccgctttccacgataccgccaccgtccgtcagttgctgaatttacggccgtcgccggagtttgaacgctggctggaaacgatgggcattatggcaaacggtcgtctgaccaaacgggcgggcgatccgtcactgttcttctgatgacgcggggataacaccatggatcaaaaacagattgaagaaattgtacgtagcgtgatggcgtcaatgggacaggacgtaccgcagcccgtcgcgccgtcaacgcaggaaggcgcaaagccgcagtgcgccgcgccgacggtgaccgaaagctgcgcgctggatttaggttccgcagaggcaaaagcctggattggcgtcgagaatccgcatcgtgcggacgtgctgaccgaactgcgtcgcagtactgcggcacgcgtctgtacgggtcgtgccgggccgcgtccgcgcacccaggcgctgttgcgcttcctggcggatcactcccgttcgaaagacaccgtgctcaaagaagtgccggaagagtggggcaaagcgcaagggctgctggaagtacgttcggagatcagcgacaaaaacctgtacctgacgcgcccggatatggggcgtcgcctgagcccggaagccattgacgcgctgaagtcgcagtgcgtgatgaacccggatgtgcaggtagtggtctccgatggcctctctacggatgcgatcaccgccaactatgaagagatcctgccgccgctgcttgccggtctgaagcaggccgggctgaacgtcggcacgccgttctttgtgcgctatggccgcgtgaagattgaagatcagattggcgaaattctcggcgcgaaggtcgtcatcctgctggtgggcgaacgtccggggctggggcagtcggaaagcctctcctgctacgccgtctattccccgcgcgtggcgaccaccgtcgaggccgacagaacctgtatttcaaacattcatcagggggggacgccgccagtagaagctgccgccgtgattgtggatttggccaaacggatgctggagcagaaagcgtccggcatcaacatgacccgttaaggagacatcatgcctgcattagatttgattcgaccttcagtgactgccatgcgcgtgattgcctccgtgaatgacggctttgcgcgggaacttaaattaccgccacatatacgtagtctcggactcatcacggcagattctgatgatgtgacctatattgccgctgacgaagcgaccaaacaggcgatggtggaagtagtctatggccgctccctctatgccggggcggctcacgggccgtcgcctaccgccggtgaagtgttgattatgctgggcggaccgaacccggcggaagtgcgcgccggtctggatgcgatggtcgccagtattgaaaacggcgcggcgttccagtgggcgaacgatgcggaaaataccgcgttcctggcgcatgtggtttcgcgtaccggctcgtacctctcgtctaccgcaggtatcgcgctgggcgatccaatggcctacctggtggcgccgccgctggaagcgacattcggcattgacgcggcgatgaaatccgctgacgttcaactggtgacttacgtgccgccgccgtcggaaaccaactattcggccgcgtttttaacgggaagccaggccgcgtgtaaagccgcctgcaacgcctttaccgacgccgtgctggatatcgcccgtaaccctgtccagcgtgcgtaacggaggctgccaatgatcaatgccctgggattactggaagtggacggaatggtcgccgccgtcgatgcggcggatgccatgctgaaagcggccaacgtgcgtttgctcagtcaccaagtgctcgaccctggcaggctcacgctggtggtggagggcgatctggcggcgtgtcgtgcggcgctagatgccggaagcgccgccgcgcagcacacaggccgtgtgattagtcgcaaagaaattggtcgtccggaagaggacacccagtggctgattggcgggtttgcgcgtgcgacaacgccgactgagaaagcgccccaggtacccgcaacgcctgagttcgctgaagcgttactggcgctgctggcatcagtacgccagggaatgacggcgggagaggtggccgcgcattttggctggccgctggagcaggccagaaacgtgctggaacaactcttttctgacggagcgttgcgtaaacgcagtagtcgctatcgcatcaaaaattaatctgtcggagggccgggcgtcctggcgggcgtccggcatagaagatcatgaaaaaaacccgtacagcgaatttgcaccatctttatcatgaagcgttacccgaagacgttaaacttacgcccagagtcgaggtggacaatgttcatcagcgacggacgacggatgtctatgaacatgctctgactatcaccgcctggcagcagatctacgatcagttacacctgggtaaatttcatggcgagttcacggaaatcctgcttgatgagattcaggtgttccgtgaatacaccggcctggcgctgcgtcagtcgtgtctggtttggccaaactctttctggtttggtattccggcgacgcgcggcgaacagggatttattggcgcgcaggggctcggcagcgccgagattgccacccgaccgggaggcaccgagtttgaactgagcacgccggatgattacaccattctgggcgtcgttatctcggaagatgttatttcccgtcaggccacgtttttgcataacccggaaagggtgctgcatatgctgcgtaaccagttagcgctggaggtaaaagagcagcataaagcggcgctgtggggctttgtgcagcaggcgctggccacctttagcgagagtcctgaaaccctgcatcaacctgcggtgcgtaaggtcttgagtgataatttgttgctggcgatgggcacgatgctggaagaggcgaagccgattcatagcgccgaaagcatcagccatcagggatatcgtaggctactgtcgcgggcgcgggaatatgtgctggaaaatatgtcggagccgctgacggtgctcgacttatgtaaccagctacacgtaagccgtcgcacgctgcaaaatgcgtttcacgccattttgggcattggccccaatgcgtggctgaaacgtattcgcctcaatgcagtgcgccgggagttgattagcccgtggtcgcagagcaccacggtcagagatgccgcgatgcagtggggattctggcatctggggcagtttgccaccgattatcagcaattatttgccgaaaaaccgtcgttgacgctgcatcaacggatgcggcaatgggcttgatattgatgggtaggctctccggttgctgataacgtgcgcgtgtcgggaattgcccggtggcggctggcgccttaccgggcctacggattcgctgctgtttgtggttggtagcccggacaaggcgcgccagcgccgcctccggggaagcgcgcgcacaacgtgcaaaacagttttgtcatcagatcatgaggatgagcgtttatgtttgctgataagacgttgccgttgtttggcaggaggggcagataaacccgtaaagcattccttccgcatattcctcttcctcgatatcttcatagcttagctgcgcaagaaacatcatcgtttgcgcgcacgttgggcacgtgggatagtctgtatcctgaacccatgcgggatggccgccgagctgtgagaaggtggtgggtaaaaatatttcagcagcgaatagcggcaaacgggattccccggggtgcagaacatcaagcggtagcgttatccagtcagaggaattctccaccgccagcgtcgagagcgcatttttttcgtaccatcgcggctggccttgtggatcgacggtggcgaaaacggtgttatatgccgtacaacactgacaggtcagaatacgaatttgaccgggccaaccctgcgtgcttaggccgacggcgctcggcgcaacctcaaacagattgattagcggcagggaacagtgtgggcagttttcaccatattctgcaacggcgcgaaaaacggccggctgttcaggtgcctgttttaccagatgggtacattgcgtaaagtaaagatcgcgcctgcggccattttcagtgagctcccatcccgcctggtgagcatagcgatgagggaggatatgaagtgaagcactccacgcaggtggttcctggcgccagcggttaaaatgctcaacgacaacctcatcgccaatccaggccagggcgcaaagaatgccatcacggttttcgtcatcggtttcaaccttctgcaaaagcgcgtcgcgtacgtcaggcggcgcacggtgaaaaggtaggggtgaagagagctccagttcctcttcatttattacttggcgcaggaaattatccagattggcctgggtaaatgccgccaggcacagcgcaatttcctgagcttcctcctgccatccggaatcaaataattcttctgcataatcgaccatgtcgcggctttcatcatcggagagctttttgtaaagctcatcggtcggaatggggcagggaatccactcgattaacggatcgtgttcccggggttcatgaacgagtttaagcatttcaacagggttggtaatgccactgaacgcgtcgatcgtttttctgtttttccggatatattcttcctgctcttgccgatagcgcgcctggacgcagggcatgcaatagccctccgtgcgggcagccgttgctggcaggatgaaatgtgagcattgcgggtttttacaaggaatacgctcgtccatgcggtagtgctccactgcaaattctacgagtgtttactgtactgttttactaatgataacggcagcgggcggttatccgaattctttatctacaatgaactcgtttatttctacgagcctgcttttattcaacggccaaccggataggcgataaacaaaccggctatcgtcaaaatacatgccagtaggcatagcaagatgcagttaacgcttttacgcggaatatgaataataaagcagagtaatgctatcagggccatgaccacagggatggtcaccatattgataaccagaagcacgatcagaccgaagctcacccctccgctatgagggatgaatattctttcttcaaaatatatttctagcgtaatggcaagcaggcagccaataaaacttatacccagatggggatgccatttggcgtcactggttactactttccgtgtatttgtttgcattgttttactttataaataagttaaatccagtcgcgtacctgaataaactcgctcagcgccgcttccgggctacccgcttccggctgccagtcgtactcccagcgcaccagcggcggcatcgacatcaggatagattcagtgcgcccgccggtttgcagaccaaacagggtgcctctgtcccataccagattgaactccacgtagcgaccgcggcgataaagttgaaaattacgctcccgctctccccagaccatcgctttgcgtcgttcgacaatcggtaaatacgcctcggtgtagccgttaccgaccgcctgcataaaagcaaaacagtggtcgaaatccggcgtattcaaatcgtcaaaaaacaggccgccgataccgcgctgctcgttacgatgcttgaggaaaaagtagtcatcgcaccactttttatagcgcggatacacatcgtcgccaaacggctggcacaggtcgcgggcggtgcggtgccagtgaacggcatcctcttcaaagccgtagtagggcgttaaatcgaacccgccgccaaaccaccacaccggatcggcgcccggtttttcggcaataaaaaagcgcacgttagcatggctggtgggaatatacggattgtgcggatgcaccaccagcgatacgcccatcgcttcaaaactacgcccggccagttctggccgatgtgcggtggcggacgcgggcattgcatcgccgtgaacgtgagagaaattaacgcccgcctgttcgaaaattccgccgttgcgtaatacccggctgcgtccgccgccgcccgcttcgcgtcgccagctatcttcgataaagtttgcgccatccacagcggataacgtttggcaaatatcatcctgcaggcgtagcagaaactgttttacgtgatgtgcatcgggtttcatgattaccgtttcttcgtgtgtgctttctgattatcaaaccagtgaaaataactgatgatgccgttggcgatcgccgtagcgattttctggcgaaacgccgtcgtgcccagcaggcgttcttcttccggattggtaataaacgaggtttcgaccagtaccgacggaattgacggtgattttagcaccacgaaagccgcttgttcggtagtgcggctgtgtaatttatgtatgggtttgattttcttgagaatatgcgaacccagcgtcagactgtttttaatcgtatcggtttgcaccagatcaaacaaaacttgttgtaatagatgatcccggtcagtggcttttttacccgccacttcgtccgcgcggttttcacgctcggagagatacttcgccatggcgctactggccccgcggttggaaagcgcaaaaacggaagcgcccgccgctttcggattggtaaaaccatcggcatgaatagacataaacagatccgcgccgtgcttatgggcgatttccactcgatcgtacagcggaataaaggtatcccctgtccgggttaaacgcgcatcgattccgtgatttcgcaaaatagcgcgtacgtttttggcaattgccagtacgacgtgtttttcctgagaaccgttgcggccaatcgcgccggtatcgatgccgccgtgtccggggtcgagcatcaccaaccgtttactgccggtttttttggttttgggtttgctgtgaccattactggtttttagcgtttcttctttggctattgcgtgcgacatacctgacagcgtcagggccgccagacctgttttgagtacctggcggcgcgatgtgagagtttttaggagtttaaaagtgctcatacggcctgagttgtgaaaattaagttcaagatgttatatcgtatcgcgtaatccgttacgacggttggtgatgagaattgttttacttttcatttcaatacgtgacacatcgccattatgccattttttccgctacatcgcgtcagatattggctgaatcagatgtttgcgccataatcttggtttttccacccgaaaaggcaacgaataccatggaaatacgcgtttttcgccaggaagatttcgaagaggtgattaccctctgggagcgttgcgacctgctgcgtccatggaacgatcctgaaatggatattgaacgcaaggtgaatcacgatgtcagcttgttcctcgttgcggaagttagcggcgaagtcgtcggtacggtaatgggcggttatgacgggcatcgcggctcggcgtattacctgggcgttcacccggagttccgcgggcgcggcattgcgaatgcgctgcttaaccggctggaaaaaaaactcatcgcccgcgggtgtccgaaaatccaaattatggtgcgtgatgataacgacgttgtgctgggcatgtatgaacgtctggggtatgagcattctgacgccctaagtttgggtaaacgcctgattgaagatgaagagtactgagtttcatccagccgattatgatgtacacggatgtttacgcctgccgtttctgttctggtgcgtactgctacttcaggcgcgcgcctgggtactctttgtcattgccggttcatcccgtggacagggtaatactttgttaaactttttttatcccgaccatgataatttttggctggggctgttgcccggcgttccggcggtagtggcgtttttactcagcgggcggcgtgaagcggttcctggtgtgtggcgctggctgcgcggactcctgatcctcgctcaactggtgtcgttgtgctggctgccggtgatgtggctgggtggcgacccggtcaacggcgtcgggctggcgctgctgctggcggacatcgtcgcgctgatctggctgttaaccaatcaacgtttgcgtgcctgtttttcccttgagaaagaataacggcactttttggcgaacccgtactccaaccaacgttaattaataaaagaaaggaagtgagatgaaatcgctgcgtttgactttactcgcactgccgctggcgctgaccggctgctcgacgctctcctcggtcaactggtctgccgcaaatccatggaactggtttggttcctcgacagaagtcactgagcaaggcgtgggagcgctgaccgccgccacgccgctggaagagccggctattgcagaggcattagatggcgattatcgcctgcgtagcggtatgaaaaccgataacggcaacgtggtgcgctttttcgaagcgatgaagggcgacagcgtcgcgatggtgatcaacggcgagcagggaaccgtgagccgtattgatgtgctggacagcgatatcccaaccgccgcggggggcaaaatcggtacgccgtttagcgacctttacagcaaagcgtttggtcactgcgagccggtttccagcgatagccataccagcgtcgaatgtaaagccgagggaagtcagcatattagctatgttttctccggcgagtggagcggaccggaaggcttaatgcctcctgatgacgtcttaaaaaactgggacgtgcgcaaaattatctggcgtcgttaatttgcgcctgaacaaaccgcttcgcttaaaaacaaggtaaaataacctccattaatgccacgactgcgtggcattctcattttcaggaggaatcatgtctcaggttcaaagtggcattttgccggaacattgccgtgcggcaatttggattgaagccaatgtaaaaggcgacctggacgccctgcgcgcggccagcagaacatttgccgataaactggcgaccttcgaagtcaaatttccggacgcccatcttggggccgttgtggcgtttggcaacaatacctggcgtgccctgagtggcggcgtcggggcggaagaactgaaagattttattccttatggtaaagggctggcgccagccacgcagtatgacatgctgatccatatcctttccctgcgccacgatgtgaatttttctgttgctcaggcggcgatggaagccttcggcgactgtatcgacgtgaaagaagaagttcacggcttccgttgggtggaagaacgcgatctgagcggctttgtcgacgggacagagaacccggcgggcgaagagacgcgtcgtgaagtggcggtgatcaaagatggcgtggatgccggcggcagttatgtgttcgtgcagcgttgggaacacaatctcaagcaacttaaccggatgagtattcacgatcaggagatgatgatcgggcgtaccaaagaagccaatgaagagattgacggcgatgcgcgtccggcaacatctcacctgagccgcgtcgatctcaaagaagatggcaaagggctgaagattgtgcgtcagagcctgccatacggcaccgccagcggtactcatggtctctatttctgcgcttactgcgcacgcctgcacaatatcgaacagcagcttctgagtatgttcggcgataccgacggtaaacgcgacgcaatgctgcgcttcaccaaaccggtgactggcggctactattttgcgccgtcgctggatcgcctgttagcgctataagtaaaaccctgtcggatggcagcgcaaacgctttattcgacctacgattggtaggcctgacaagcgccgcgccatcaggcagaacagcataaaaatgcccatccccgcctccgcggggatttttttacctaatatttacctgaattagtgagctattcctcagcacttatttgttattactgtattttcagtgttaatggagtgtaagactccatattcaaaaggagacattgaaaatgggtaaactcacgggcaagacagcattgattacgggcgcatcgcagggcattggcgaagggatcgctcgcgtattcgcacgccacggcgcgaacttaatcttgctggatatctccgatgagattgaaaagctggcggatgagctgggcgggcgcgggcatcgctgtactgccgttaaagccgacgtcagagattttgcttcggtgcaggcggcggttgcgcgcgccaaagagactgaaggtagaattgatattttggtgaataacgctggcgtgtgccgtctgggcaacttcctcgatatgagtgaagaagatcgcgatttccacattgatattaatattaaaggtgtctggaacgtcaccaaagccgtcctgccggagatgatcaaacgtaaagatggccgcattgtgatgatgtcttccgtcacgggagatatggtggcggacccgggtgaaacggcctatgcgctgtcaaaagccgccattgtcggtttaaccaaatcgctggcggtagagtacgcgcagtccggtattcgtgtgaatgccatttgccccggttatgtaagaacgccgatggcggaaagcattgcccgtcagtctaaccctgacgatccggaatcggtattaacggaaatggcaaaagccattccgctacgccgtcttgccgatccgctggaagtaggggaactggcggcatttctggcttccgatgagtccagctatcttaccggaacgcaaaacgtcattgatggcggcagtaccctgcctgaaagcgtaagcgtaggcgtctgattgatgccggtctcctcctcacgccgcgtggggagggattctcttattcccttttcaactttcaaatcatcaaacggtatataaaaccgttactcctttagcgctggttataaatatgatgaccataagaaagtcattaaatttataagggtgcgcaatggccgttaacttactgaaaaagagactcctgacgctggcagcaatgctgttactggcagggcaggcgcaggcaacggagctgctgaacagctcatacgatgtctcccgcgagctgtttgccgcccttaacccgccgtttgagcaacaatgggcgaaggataacggcggcgataagctgacgattaagcagtctcatgccgggtcatcaaaacaggcgctggcgattttgcagggactgaaggcagacgtcgtgacctacaatcaggtgaccgacgtacagattcttcatgataaaggcaaactgatccctgccgactggcaaagccgtctgccgaacaacagttcgccattctattccactatgggcttcctagtgcgcaaggggaacccgaaaaatattcacgactggagcgatcttgtacgtttcgacgtgaagctgattttccctaacccgaaaacctccggcaacgcccgttacacgtatctggcggcatggggcgcggcggataacgcggacggcggcgataaagccaaaaccgaacagtttatgacccagttcctgaaaaacgtcgaagtgtttgataccggcggtcgcggcgctacgactacctttgccgagcgtggtctgggcgatgtgctgattagttttgaatcggaagtgaacaacatccgcaaacaatatgaagcccagggatttgaagtggtgatcccgaaaacgaacattcttgctgaattcccggttgcctgggtggataaatacgtgaaggccaacggcacagaaaaagccgccaaagcttacctgaactggctgtatagcccgcaggcgcagaccatcattacccattactactaccgcgtgaataacccggaaatcatgggcaagcaagcagataaattcccgcaaaccggactgttccgcgtggaagacaagtttggcacgtggcctgaggtgatgaaaacgcactttgccagcggcggcgagctggacaaactgttggcggcggggcgtaagtaatgcttgccgtttcttcccgacgcgtgctgcccggctttacgttaagcctcggcaccagtttgctgtttgtctgcctgatcctgctgttgccgttgagtgcgctggtgatgcagctctcacagatgagctggtcgcaatactgggatgtcgtgaccaacccacaggtggtggctgcttataaagtgacgctgctggcggcatttgtggcgtcgatttttaatggcgtgtttggcctgctgatggcgtggattttaacccgctaccgttttccagggcgcacgttactggatgcgctgatggatctgccatttgcgctgccgacagcggtggcggggttaacgctggcctcgctgttctcagtgaacggtttctacggtcagtttcttgcgcagtttgatatcaaagtgacctatacctggctcggtattgcggtggcgatggcctttaccagcattccatttgtggtgcgcaccgtccagccggtactggaagagctggggccggaatatgaagaagcggcacaaacgctgggggccacccgcctgcaaagttttcgcaaagtcgtgctgcctgagctgtcgcctgcgctgattgccggcgtggcgctctcttttacccgtagcctgggcgagtttggcgcggtgatttttatcgccggaaatatcgcctggaaaacagaagtgacctcgctgatgatttttgtgcgtttgcaggagtttgattacccagctgccagcgccattgcctcggtgatccttgcggcatcactgctgctgctgttctcaattaacactctgcaaagtcgctttggtcgacgtgtggtaggtcattaatggcggaagtgactcaattgaagcgatacgacgtcccccgtattaactggggaaaatggtttttgattggcgtcgggatgctcgtttcggcctttatcctgctggtgccgatgatttacatcttcgtgcaggcgttcagcaaagggttaatgccggtactgcaaaatctggccgatccggacatgctgcacgccatctggctgacggtgttgattgccttgatcgcagtgccgatgaatctggtgttcggtattctgctggcgtggctggtgacgcgctttaacttccccggacgtcagctactgctgaccctgctggatattccctttgccgtctcaccggtggtggccggtctggtttatctgttgttttatggttccaacggcccgttgggcggctggctggatgagcataatttgcaaatgatgttctcctggccggggatggtactggtcactatttttgtcacctgcccgtttgtggtgcgcgaactggtgccagtgatgctcagccagggcagccaggaagatgaggcggcgattttactgggcgcatccggctggcaaatgtttcgccgcgtgacgttgccgaatattcgctgggcgctactctacggcgtggtattaaccaacgcccgcgcgattggcgagtttggcgcggtgtcggtggtgtccggctcgattcgcggcgaaacgttatcgctaccgttacagattgaattactggagcaggactacaacaccgtcggctcctttaccgccgccgcattgttgacgctaatggcgattattaccctgtttttgaagagcatgttgcaatggcgtctggagaatcaggaaaaacgcgcgcaacaggaggaaaatcatgagcattgagatcgccagaattaagaaatcgtttggtcgcactcaggtactgaatgatatctcgctggatattccttccggccagatggttgccttgttggggccgtctggttccggcaaaacgacgctgctgcgcattattgccgggctggaacatcagtccagcggccatattcgtttccacggtacggacgttagccgcctgcacgcgcgtgagcgtaaagtcggttttgtgtttcagcactatgcgctgtttcgccatatgacggtgtttgacaacatcgcttttggcctgacggtgctgccgcgacgcgaccgcccaactgcggcggctattaaaacgaaagtgacgcaattgctggagatggtgcaactggcgcacctcgcggatcgcttccccgcccagctttccggcggacaaaaacagcgcgtggcgctggcgcgcgcgcttgccgtagaaccgcaaattctactgctggatgaaccgtttggcgcgctggatgcccaggtacgtaaagagttacgtcgctggttgcgccagctacatgaagaactgaaattcaccagcgtctttgtcacccacgatcaggaagaagcgacggaagtggcggatcgggtggtggtaatgagtcagggcaatatcgaacaggctgacgcgccggatcgggtgtggcgtgaaccggcaacccgcttcgtactggagtttatgggcgaggtgaaccgcctgacaggcaccgtccgcggcgggcagtttcacgttggcgcgcatcgctggccgctgggttatacgcccgcgtaccaagggccggtcgatctgttcctgcgtccgtgggaggtggatatcagccgccgcaccagcctggattctccgctaccagtacaggtcattgaggcaagcccgaaaggtcactatacacagttagtggtacagccgctggggtggtatcacgatccgctgacggtggtgatggcgggtgacgacgtcccgcagcgcggcgagcgtttgtttgtcggcttacagaacgcacgtctctatcatggcgaccagcgtattgagccccatgaggcgcttgctcttgcggagtctgcctgataggttaatttgcatagttatcgcccggtggcgcttcgcttaccgggcctacagcgtatatcgtgattttgtaggccgggtaagcacagcgccacccggcatttttattgagctgaaaacgtgaatacattagaacaaaccatcggcaatacgccgctggtcaaattacaacggctggggccggataacggcagtgaaatctgggtcaagctggaaggcaataatccggcaggatcggtgaaagatcgcgcggcgctatcgatgattgtcgaggcggaaaagcgcggggaaattaaaccgggcgatgccctgattgaagcgaccagcggcaacactggcattgcgctggcgatgatcgccgcgctgaaaggttatcgcatgaagctgttgatgccggacaacatgagccaggagcgtcgggcggcaatgcgggcctatggcgcggaactgattctggtcactaaagagcagggaatggaaggggcgcgcgatttagcgctcgctatgtctgagcgcggagaaggtaaactgctcgatcagtttaataatcctgataatccctacgcccactacacgaccaccggcccggaaatctggcggcaaacgtcaggtcgcatcacccattttgtctccagcatgggcacgaccggcaccattaccggcgtgtcgcgttttctgcgcgagcaggaaaaaacggtcaccatcgttggcctgcaaccggaagagggcagcagtattccgggcattcgccgctggcctacggaatatatgccgggcatatttaacgcctcgctggtggatgaggtgctggatattcatcagaatgatgccgaaaacaccatgcgtgaactggcggttcgtgaagggattttctgcggcgtcagctccggcggcgcggtagcgggcgcgttacgcgtcgcacgagccacgcccggcgcgatagtggtggcgatcatctgcgatcgcggcgaccgttacttgtctaccggcgtgtttggtgaagagcatttcagccagggggcagggatttaaacgaggtgccatcgtcgtatgacacccgtgtgttatagcgttttatccgtttccgcaataagtgcatgtaaataaggctgcgcgttttcatcgcttttaccaggaattttaacgatatagggttttccggtgatggacgacgacgacgcgactttatcgataaactgttcagcggtgtcgatacgattgcgcgtgttacccagttttaagcgcaggtgcgatacggcttcctcgcagttatgcgcatcaccgttacgaacgaaggtcagatcctttttctgcgccagcacattaagcatggcgttaatgcgcgcttcttcatgggcgtttagcttcgcccaggcggggagggtcagcaggagcgcgacgacggcgcagacaattttcttcatggtaaaatcctttttcatgcaataatcactgcacctcagaccgttagccgggtaataagttgcactcctggtgtggttatttctgtgagtgcgccagcgtgagttcatccagaaaacgccacagcttttcattcatctgctgataattccatgcgcgcatctcggcgaccgagcggataaaacgcttcccttgcgcgtcggccagctcctgctgcgaatgttggattaatccttcaaccgcctcgacggtaaattccatatgacactggaagccgtagacaaaattgccgtactgcacgatttgtcgcgggcagccctcactggtagcaagaattatcgcctggtcggttaaccccggcatgtcgttatgccagtgaccgacgataagcggggagccgaaatggttgaacagcgggtgctgttggcctgcctcggtcaggacgattgggtagtgaccgatctctttttccggactttggcacaccttggcgcccagcgcttcgccaattaactgcgagcccaaacagatccccaccacgatttttcgtgccgaaatcgcctggttaatcagatgttgctcggcctgagaatcaaagtacgggcactcttcgcgggtggtgcgcggcgactgcggaccgccaaataccacgagcatatcgaactcatctgcattgggcggtagcgcttctccggcatagacgcgcgaccatgaaatggtataaccgcgatcttcagcccatttcagataagcgccagcggattcaaacgactcatggataacaaaatgaactcgcacgttattttctcctgttagcgatttagcgcctgatggatatcagccgccagcgtgttgatctcgccgtcatttaatgtcgacagcgtgatacgtagaccgtgagacggcgcgcttacgccaaaggcttcgccctcacgtaccagccagccggattttgccagcgtaaacgcggtagcctggctatgggtgtccagcgggagccaggcattcacgccgtcgccgggagaaatggcgatgccatattgctgtagggcgcgggccagtttttgttgccgggtggcgtaaaacagccgcgtttgcgccagcctgtgctgatactcagggtcggtcaggcaggcgtagaccagatcctgtaacagatggctgacccactgactaccggcatttagccgcagccgaagttttgccgaggtcgagctgtcgctggcgacaatagcaagacgtaaatcggggccgagggctttggaaacggagcgtatcaccgcccagtgttgcgttgtctgcgcaataaccggctgccagggcgacgaagaaagcagggcgaagtgatcgtcgataatgaccagtacctgagggtaacgcgccagtatattttgcagcgcagcggcacggcgagcgctcaggctacagccggtagggttgtgtgcgcgcggcgttaagatcactgcccgcgcgccctggtttagcgcctgctccagcttttcaggctgcattccttcgctatccacactgaccgggctggcgctaaaaccggcatagcgcagcatattgatactgcttaaaaaacagggatcttccaccgcaacgctgtcgcccggcagcagatgcgcgcaaagcagtctttcgatagcgtcgatagctccgctggtgatatcaatttcgcctgcgacgggggtggcatcccgtagccagcgcgccgcccaggcgtgtagttcaggggaaacgggcgcatcgccgtagagatgcggcgtgcggctgagacgggcaaaataacggctaaggtcaggcagacgctgcggatcgggattgccgccggaaaggtcgtgcagaggcgtatgcggatcgccgccttccaacgctacgggagacggactgcctttaatcaccgtcccattgcggcctaaactttgcgccagtcccgccgttatcagccgtttatacgccgctgcgacggtattgcggttcacctttaattcgcttgccagctcccgtaccggcgggagcgaatccttcgcccgtaacgtgccggcgataatgtgttgacggatactgtcaaaaatttcgttagcggtttttccgtcgatcattattgacctatgacaaaatgaattttagcatatgacaatgataatgaggcggtagcctgctgtccagcgagaggaaaattttatgggacaagagagtgatattcagtcagtgctcttcgacgacaaccatcgggcgttacagaccgatatcgtcgccgtccagtcacaggttgtgtacggcagcgtaggcaacagtatcgctgttccggccattaaagcgcagggattacgcgtgacggcggtcccgacggtgttgttcagcaatacgccgcactataaaacgttttatggcggcattattcccgccgagtggtttgcaggctaccttacggcgttgaatgagcgcgatgcgctacgtgaattaaaagcgattaccaccggttacatgggcagcgcagaccaaattgtcttgctttcgaagtggctaatggcgatccgggcttcgcatccggaggtgtgtattcttgttgatcccgtcattggcgataccgacagtggaatgtatgtgcaggcggaaattccgcaggcttatcgcacacatttgttgccgcaggcgcaggggctaacgccgaacgtatttgagctggagatgctgagtggtaaaccgtgtcgcacgctggaagaggcggtggcggcggcgcaatcgctgctttccgatacgctgaaatgggtggttatcaccagcgcgccgggcgaatctctggagaccataacggttgccgtcgttaccgcgcaggtcgtggaggtctttgcccatccgcgggtggcgacggagttaaaagggacgggagatctcttctgcgccgagctggtcagcggtattgtgcagggaaaaaaactgacgaccgcggcaaaagatgcggcgcagcgcgtgctggaggtgatgacctggacacagcagtgtggctgtgatgagttaattctgccgccggcaggggaggcgcgatgaagagttatcggctggtggttcgccagcaggggcgtatcgtggggcattttgaaacgagcgggctggacgcgctggaagatatctgcgtggcgcgagcgatgtttggcatcactggcggctatcagtgcgagttgcaagtgtccgattccgaacgcaggatactggagagtggcccggatgggatgaagatcctgatgcgcgagaagtgctttcgcccggtgacctcgcagttgtaacccgtggattggcgctgaaatgttcgcaaccttgtaggcctgataagcgtagcgccatcaggcagtgcgccgcaccatcgccggatggcggcgcaagtacaggcaaaaaaaatggcgcccaaaggcgccattcttcactgcggcaagaattacttcttaatgcggataaccggagtttcacccacggtcacgctaccggacagtttgatcagttctttgatttcatccatgttggagataacaaccggagtcagggtagacttggctttttcttccagcaacggcagatcgaactcgatgaccggatcgccaactttcacgcgctgaccttcttcagcaatacgcttgaagccttcgcctttcagctcaacggtgtcgataccgaagtgaacgaacagctcaatgccgctatcggattcgatagagaacgcatggttggtttcaaagattttgccgatggtaccgtcaacaggggcgaccattttgttaccggttggtttgatagcgatgccatcaccaacgattttttcagcaaaaactacatccggcacgtcttcgatgttgacgatctcgccagagagcggggcaacaatctcaatagttccggtgtctttcttatcatcagaaaccagagattttagtttatcgaacaaacccatgatcttctcctaagcagtaaattgggccgcatctcgtggattagcagattgttttttcttcaatgaacttgttaaccagcgtcattaactcgtccgttgtcggttgagcaagagcctgctctgctaacaccttcgcatcttcgaagttcgtgttacggataatcttcttaatgcgcgggatagaaatggcgctcatagagaattcgtccagacccatccccagcaacagaagtgtagcacgttcgtcgcctgcaagctcaccacacatgccagtccatttaccttctgcatgagaagcatcaataacttgcttgatcaagttcagtacggacggtgacattggctggtaaaggtgtgaaatcatatcattaccacggtcaactgccagggtgtactgcgttaaatcattggtgccgatactaaagaaatcaacttctttggctaaatgacgcgcaattgtcgccgcagccggtgtttccaccatcacgccaatctcaatgctttcgtcaaatgctttaccttcgtcacgcagttcctgtttgtagatttcaatctctttgcgcagcgcgcgaacttcttcaacagagatgatcatcgggaacataatgcgcaatttaccgaaagcggaggcacgcagaatcgcgcgaacctggtcacgcaggatctctttgcgatccatggcgatacgcacggcgcgccagcccaggaacgggttctcttctttcgggaagttcatgtatggcagctctttgtcgccgccaatgtccatggtacggacgataaccgcctgcgagccgcacgcttcagcgaccgctttataggcggcaaactgctcttcttccgtcggcagcgcgtcgcgatccatgaacaggaattcagtacgatacagaccaacgccttccgcgccgttacgctcagcgccttcaacgtcacgaacggtaccgatgttggcgcaaacttcaacctgatgtccatccagcgtgattgccggcagatctttcagttttgcgagttccgctttctcggtcgcaacctgctcctggacggcgcgcagttgctcaataacatcgttggtcgggttgacgtaaacctggttgtttacggcatccagaatcagatagtcgccgtttttcacctgagcggtgacgctaccggtacctacgatcgctggcagttccagagaacgcgccatgatggaggtatgagacgtgcgtccgcccgcgtcggtgatgaagcccagcactttctgcaggttcagctgtgcggtttctgacggcgtcaggtcagcggcaaccaggataacttcttcctgaatcgcgctcagatcgataatggccagacccaggatgttgcgcagcaggcgcttaccgatatcacgtacgtcagccgcacgctctttcaggtattcgtcatccagttcttccagggcagtggcctgaccttcgataacttcatgtgcggctgcgtcagccgtcatgtgcttatctttaatcagggctatgatttcctgctccagctcctcatcttcgagcagcataatatgcccttcaaagatggcttctttttcttcaccgaacgtttcaccagcttttgtcttgatcgcttccagttgcgcagatgccttggcacgaccgctcagaaaacgttcaacttcctgatcaaccttgtcggcagaaatttttttccggtcaatgacgatttcgtcttctttcagcagcagtgctttgccgaaagcgatacccggggatgctaaaatgcctgaaatcataaccctaccttacttgtgactgatttttaaaagaacccggaaaaaaacttactcgagttccgccatcagtttgaccagatgttcaaccgctttctgctcatcttcaccttctgcggagatggtgacgacggtgccttgagtcaggcccagagtctgcagtttaaacaggcttttcgcgctggcgcttttgccgttggaagtcacagtaatctcagaagtgaagccttttgcttctttaacaaactgagcagcagggcgggtgtgcagaccgttcggagcggtaatggtaacttcttgctggaacattgtatttccccaacttataggtttagtgttgtggaactaaagtctagcctggcggctcaactttagcctgtattgttagcgccggcgtaaacgggacgcgacacaaaaggtgttctacgcaatccgttgctggcaacttatggccgctgacgtttcgctcgtcattaaacattatgccgcgaaaggaagagttgaaccaaatcataaaatcgattcagctaacgcttttcctgtaacgattaatttcgcgcatcaaaataattagtctggttaaataccagttccggcagggtgaatcaatgccaggtgaggtgaaagtttgaagcaggccacaaaaaagcacccaaaaaggtgcttttttacgcgtttttaacatgctggcatcactgttgcagttctttctcagtaaagagatcggcgaacaacgcggtgctcagataacgctcacctgatgagggtaggataaccacaatattcttattggtaaagctttcatcttcctgcagcttaagcgctgcagcaaccgcggcgccggaagaaattcccgccagaataccttcctcttccatcagacggcgcgcggtagaaatggcttcttcattggtgatgccaaccactttatcaatcagtttcagatccaggttgcccgggatgaagcctgcgccgatgccctgaattttatgtgggcccggtttgatctcttcaccagccagcgcctgggcgataaccggggagtcagtgggttctaccgcaacggtgataagatcggttttacccttcgtccctttgatataacgcgtgacgccggttaacgtaccgccagtgccgacgccggagataaacacatccacctgaccatcggtgtcttcccagatttccgggccggtggttttttcatggatttccgggttggcagggttgctgaactgctggagcaggagatatttttgcggatcgctggcgacaatttcttcggctttctgaatagcgcctttcatccctttcgccccttcggtcagcaccagattcgcgcctaatgctttgagtagcttgcggcgttcaatgctcatggtttccggcatggtcagggtgagtttgtaaccgcgcgcggcggcgacatacgccagcgcaataccggtattgccgctggtcggctccaccagttccacgccaggtttcagtacgccacgcttttcggcatcccaaatcatattggcgccgatacggcacttgacgctgaagctcgggttgcgcgactccaccttcgccagaatgcgtccattaccgatacgattcagtcgaaccagcggcgtatgaccgatagtcagcgagttatcttcataaatcttactcatggcctgtccttaactgtatgaaattgggataccttcccagcataccttccagccagatatggggaagtaaggatttcgcatatctatatgctgatggggaataatggttatcagtatggaataagagacagcataagagcctatcccattagggctattttacttgccattttggtcctgggcagtgctcgccaaaacgcattagcgttttgaacgccgcttgcggcggcccgaagggcgagcgtagcgagtcaaacctcacatactacgtgtacgctccggtttttgcgcgctgtccgtgtccaaactggctgcgccaataacgcttggtgggataggctctaagccatctcttatttatacatttttacgttatttccataacgcgtgtttagcacgccagcaatcaacccacattgccgtcgcgccacagacggcgacaggcataatgaaaaggttaagcaccggaatcatcgtaaagaggctggtgagcgcgccaaattgcatattcgccaccttctgcgtgcgcaacgcggcgcgcatcgttttaaacggcactttgtggttatcaaacgggtagtcgcaatactggatcgccagcatccaggcgctgaacaaaaaccacagcaccggcgcgatggtttggccaatgccaggaataaaatagagaaccagcagcacaatagcgcgcggcagataccacgccagcttttgccattcacgtttcataatgcgcggtacatctttcatgatgccgagtatgccggtatctggcggcgtagcgccggttaaccgcgcctcaagctgttcggctaaaaggccgttaaacggcgcggcgatccagttggcgagggtagagaaaaaatagccaaagaccaacagaacagagataaccgcaatcggccacagcagatagctcagccattgcagccagtccggcacatgactcatcaacgaaggtatccaggcgtcaagctgggtaaacagccaccaaaatgcgccgcccatcagcacaatattgaccagcaaaggtaaaataacaaagcggcggattcccggtagggtgactaacttccatccttgcgagaaataatagacgccgctacgtggtacggttgtggatgatgaaaccatattcaggacatactcctttttcttaaagccctgggtaaacgtgggatatcttacccggttatcagacggtggatagttcggaaatgttcgaaaaaacagcaaaaagcacattttccttcatctttatgctgcgaaagccaacagtacacttgcacttgacgtaatcggcaaatactcttagtgagtaaatgtttgccgtggtggcaaggtgttagaacaacagagaatataatgatgcaggatttgcgtctgatattaatcattgttggcgcgatcgccataatcgctttactggtacatggtttctggaccagccgtaaagaacgatcttctatgttccgcgatcgtccactaaaacgcatgaaatcgaaacgcgacgacgactcgtatgacgacgatgtcgaagaagacgaaggcgtgggtgaagttcgtgttcaccgcgtaaatcatgcccccggccagtcgcaggagcatgatgcccctcgtcagtcgccgcaacaccagtaccagccgccttatgcgtctgcgcaaccgcgtccagcggcgccgccgcagccgcaagcgccgatgcaacagccggttcagcaaccggtccaacctgcgccgcagcctcagcaggttcagccatctgcgccgccggtacagccgccgcaacagcagcctgcaccgccgtcgcaagcgccgcagcctgttgcgcagcccgcgccgccgccatcagcgcaaaccttccagcctgcggaacctgtggttgaggcggaaccggtagtggaagaagcgccggttgtggaaaaaccgcagcgtaaagaggcggtcatcattatgaacgtcgcggcccatcatggcagcgagcttaatggtgaagtgttactgaacagtattcagcagtcaggctttaaatttggcgatatgaatattttccatcgtcatttgagcccggacggcagcggcccggccttgttcagtctcgcgaatatggtcaatccgggaacgttcgatcctgaaatgacggacttcactacgcctggcgtcactatctttatgcaggtaccgtcttacggcgatgcgctgcagaatttcaagctgatgctgcaatccgcgcagcatatcgctgatgaggtcggtggcgtcgtgctggatgaccagcgtcggatgatgacgccgcagaaactgcgcgaatatcaggaccgcatccgcgaggtgatggacgctaacgcctgaggttaacgcaggtgtgacatttttaacgtaacccccgcctgtcgggggttttttatcattgatggtgtgatatggaaccaatcgaacaacaactgacagaactgcgaaccacgcttcgccatcatgaatatctgtatcatgtgatggatgcgcccgagattctcgacgccgaatatgaccgcctgatgcgggaactgcgagagctggaggcgcaacgtccggaccttatcacgccggattcgcccacgcagcgcgttggcgcggcgccgctgacggcattcaaccagattcgccatgaagtaccgatgctgtcgctcgataacgtatttgatgaagaaagcttcctggcgtttaacaagcgagtgcaggatcgtctaaaaagcacggaaaatgtcatctggtgctgcgagctaaaactggatggcctggcggtcagcattctgtatgaaaacggcgtgctggtgagcgctgcgacgcgtggcgacggcaccaccggtgaagatatcacttcaaacgtgcgcacgattcgcgccattccgttaaagctgcacggcgataacattccggcgcgtcttgaagttcgcggagaggtatttttaccgcaggccgggttcgaaaagatcaatgaagacgcgcgccgtactggcggcaaagtgtttgctaatccgcgtaacgcggcggcgggctcgttgcgtcagctcgatccgcgtattacggcgaagcgaccgctaacatttttctgctacggcgtcggtattctggaaggcggagagttgccggatacgcatctgggacggttgctgcaatttaaagcgtgggggttaccggtcagcgatcgcgtgacgctgtgcgattctccccaggcagtactggatttttatcacaacgtcgaaaaagatcgccccacgctcggttttgatatcgacggcgtggtgattaaggtcaactcgctggctttgcaggaacagctgggctttgtggcccgcgcgccgcgctgggcggtggcgtttaaatttcctgctcaggagcagatgacttttgtgcgcgacgttgagtttcaggtcgggcgcaccggggcgattacgccggtggcgcgtctagaaccggttcaggtggctggtgtgctggtcagcaatgccacgttgcataatgccgatgaaattgagcggcttggcttgcgcattggcgataaggtggttatccgtcgggcaggcgatgtgatccctcaggtggtcaacgtggttctgtccgaacgccctgaagagacgcgtccgattgtgtttccaacgcactgtccggtgtgcggatcggacgtagagcgcgtcgaaggcgaagccgttacccgttgtaccggcgggctgatttgcggcgcgcagcgtaaagagtcgctgaaacattttgtgtcgcgccgggcgatggatgtagacgggatgggcgataagatcatcgaccaactggtggaaagggagtatgtccatacgccagcggatctgttccgtctgacggcgggtaaactgaccggcctggaccgaatggggccaaagtccgcgcaaaatgttgttaacgcgctggaaaaagccaaagcgacgacttttgcgcgttttctctatgcgctgggcatccgtgaagtgggtgaagcgacggcggcggggctggcggcgtacttcggcacgctggaggcgctgcaggctgccaccattgacgagttgcagaaagtacccgacgtggggattgtggtcgctacgcacgtctttaacttttttgccgaagagagcaatcgtgacgtgattgggcagctactggcggaaggggttcactggcccgcgccggtagtcattaatgcgcaagagatcgatagcccgtttgccggtaaaaccgtggtactaaccggtagcctgagccagatgtcccgcgatgacgctaaagcgcgtttagtggctctgggcgcgaaagtggcaggcagcgtatcgaagaaaaccgatctggtgattgccggtgaagcggcgggctccaaactggccaaagcgcaggaactgggtattaccgtgattgatgaagcggaaatgatccgcttactgggtgcctgagatggaaaaagagcagctgcttgaaatcgccaacaccgtgatgccctttggcaaatatcagggacgtcgattgatcgaccttccggaagagtatttgctgtggtttgcccgtaaagatcaatttccggcgggtaaactaggggagttgatgcaaatcacgctgctgattaaaaccgaggggctgacgcaactggtgcagcccctgaaacgcccgctttaagctttcgcggcgcggctttcctgctgcgcctgtaacttctcggtctggcgtttgtagcgccgcgccagccctgcgcagaccatcagttggatctggtggaagatcatcagcggtaataccatcatacccagcactgacgtcggaaacagaatattggccatcgggatcccgttggccaggctttttttcgaaccgcagaagacaatagtgatttcgtcggctttattgaagccgcatttacgggcgacaaagacgttaatggctatgacgatcgccagcagtatgaggctgaccacgacgataaacagcagcgatccccagccgactttgtgccagatgccgttgaccaccgcttcgctgaacgccgagtagaccaccaacagaatagaggtctgatccgttttcgcgatccactttttgttgcgcgcgacccaattgccgatccacgggcgagacaggtgtcccagcacaaaaggcagcagcagttgcagcataattttgcccacctcttccagactgccctgcgcgccatgaatattcattaccagaccgaccagcagcggcgacaggaaaatgcccagcaggctggacgcagacgctgagcacaccgcggccgcgacgttgccgcccgcgagtgaagtaaatgcaatcgccgactgcacggtggcgggcaaaatacacagatacagaaagccgctgtagagcatagggtcgacattgacaggcgcccaccaggcaaacagcacgccgaggacaggaaagagcacaaaagtgctgcacatgacccacagatgcaaccgccagtggctgccgccagcgatgatcgcttcacgcgaaagcttcgcgccatgcataaaaaacagcagagcgatagccgctgtcgtaatgccttcaacgacaggcacaaagccaccttccgccgggaaaaaagaggccagtagtaccacggtgataagtgtcagcgtgaaagggtcaaggatacgaaaaagtttcataaaaactcctgaaagtcggtgcagctattttgcgtttttcgctttgagaaataaaattgatttattgcatctatatatgaatctagtcgatgaactattcactgcgtcaactgcggatttttattaccgtcgcccaggccaaaagttttagtcgggcaggggacaggattggactgagccagtctgcggtcagtcatagcgtaaaagagctggagcggcaaaccggcgtcagactgttggatcgcaccacgcgtgaggtggtgctgaccgaggcggggcaacagctggcgacgcgtctggagcgggtgcttgatgaactgaacagcatactgcgcgatgcaggcagagtagggacacaattaaccggcaccgtgcgcgttgccgcgagccaaaccatttctgcgcatcttattccgcaatgcattgcccaaagtaattcactttatcccgctattgattttgtattgcacgatcgtccgcagcagtgggtgctggagagcatccgccagggtgaagtggattttggcatcgttatcgatcccggcgcagcggtggatttacagtgtgaagccatcttatcagagccttttttactgttgtgtcgccaggatcatccgctggcgcatcaggaatgggtgagctggcaggatcttaaacaggcctcgctggtcttacaggattatgcttccggcagtcgaccgctgattgatgcggcgctggcccattttgctattgaggcggatatcgtgcaggagattggtcacccggccacgctgtttccaatggtggaagcgggaatcggcatcagcgtgctgcccgcgctggcgttaccgctcccgcagggcagccacttacaggttaaacggctgacgcccgtagttgaaaggcagctcatgctggcgcggcgaaaaaaccgatcgctctccacggcggcgcaggcgttgtgggacgtggtgcgtactcaggccagcgaattaaccgccgcgagggcgaaagatccgctgtatcagctataaatatctatctgtccgtgtgtgaggtgcggtcttgccctgccatttttgacagggcagtgtgttaaaacaggtatttgatggaataaataatgccatcctgcaggaaggattctcctaacttattatcagcgtaacgatattgtactcctgcggtcaggtgaggagtcgcattccaccacagcgctactgcgccattaatgccatctttcccgccattgcccgcagcgtaggacgcatcgcggtcaaactcatactcattccagttcgttacgctgaatttctcactacccaacgagaagctatagccggccacccaacctaatacataaccattatcgcctgtgtagtaggtctgatcggtataacgtttggcaaagaagggtttaaaccagtaaccgttacctgtgaagttatagcctaaaccatagagaaacatgtcatcatggaaattagcgcgatgaggtgaaccgtacgtcccgtaggcatggagatagaggtttaatcctgtatcgcccagataaatacggttggtatttttaaaggtgtaacgctgttcgctgcttggtttagcgtggcggccattgtaaaaattttcccagtcgaagaacccgtacatttctccccagctaaaattcgctccgccttccagttccaggtacccaaaatcatctttatgggattttttactggttttttccgtggtgtctgatgtccagtcgaggtaatggaggccgatatcggcgaacccgcctttaaattccgcatgggtgagtgcgggaataatgagtaaagaagaaagcgtcagagtaagaatttttttcatagcatatttccctatgccgataattattaatgggttaattaaaaagaggcaatttataaatatgaaagcggcatattgttaatatgaagtgcaagcaaaaaccaatactgttttccctctgtattaatacagaagcgatctaaatctatcgatattaaatggctattgatgacacgtgaaaagtgtattggtcagcaaggggcgatggtcgttataaaaaggagtcaaattaaatccgatagaacaaggaaacttatgcctcacgctcttttttctcataatcctgagtattgtattgatattattcatgcacataaaccggcatttaccccgcgagtcgcgtttattttaggctccgggttgggtgctctggcggatcaaatcgaagatgcggtagccatttcttacgagaaattgccgggatttcccgtcagcaccgtacacggccatgctggtgaactggtgctcggccatctggcgggtgttccggtggcctgtatgaaaggccgcggacatttttatgaagggcgtggaatggcggtgatgaccgatgccattcgcacgttgaaattactgggctgtgaagtgttgttctgcaccaatgcggcaggatctctgcgtccggaagtggggccgggtagcctggttgcgcttagcgatcacattaatacgatgcccggtacgccgatggtggggccaaacgatgatcgttatggcgatcgcttcttctcgctggctaatgcttatgacgcagattatcgcgccatgcttcagtccgttgcggcagagaagggattccccctcactgaaggcgtatttgtttcttatccgggtccgaacttcgaaacggcggcagaaatccgcatgatgcagattattggcggcgatgtggtcggaatgtccgttgtccctgaggtgattagcgcacgtcattgtggcctcaaagttgttgccgtctcagcgatcaccaatctggcggaagggctgggcgatgtaaaactctcccatgcgcaaacgctggcggcggctgaactttcccggcagaactttatcaatctgatttgcggctttttacgtaagctggcctaaacacaatgactacggccccgtattggggctttatctcacggcaaggaataaaaaatgggtattacgtcccgcttaaaagtcatgtcgttcttgcaatattttatctgggggagctggctggttaccctgggctcttacatgatcaacactctggattttaccggcgcgaatgtcggtatggtctacagctcaaaaggactggcagcgattatcatgccgggcattatggggatcattgctgataaatggctgcgcgctgagcgagcctatatgctttgccatctggtttgcgcgggggcgttattgtacgccaccaccgttaccgatccccagacgatgttctgggtgatgttggttaatgcgatggcgtatatgccaacgattgcattatccaatagcgtttcgtactcctgtctggcgaaagcaggtcaggatccggtaacgtcatttccgcccgtgcgcgttttcggcacaataggttttattgttgcgatgtggacggtgagcctgatggggctggaactgagcagtgcgcaattatacatcgcttctggcgcatcgttattgctggccctgtatgcgctgacgttaccgaaaattccggtagccgagaagaaggcgaacaccacgcttgtcagtaagctcggactggatgcttttgttctgtttaaaaatccacgcatggcaatcttctttttgtttgcgatgatgttgggggcggtgctgcaaattaccaatgtcttcggtaatccgttcctgcatgattttgcccgtaatcctgagtttgccgatagttttgtggtgaagtatccctctatcttgctttcagtttcgcagatggcggaagtgggctttatcctcaccattccgttcttccttaaacgctttggtattaaaacggtaatgctgatgagcatgctggcgtggacgctgcgtttcggcttctttgcctttggcgatccatccccgtttggctttgtgctattgctgctgtcgatgattgtttatggctgcgcatttgatttcttcaacatctcagggtcagtatttgtagagcaggaggtggactcaagtattcgcgccagcgcgcaggggctgtttatgaccatggttaacggcgtgggggcgtggattgggtctcttttaagcggtatggccgtggattatttttctattgatggcgtaaaagattggcaaaccatctggctggtttttgccgcctacgctctggcattggccgttatttttgcattgttctttaaatatcagcaccatccagaaaaactgtcgaccaaatcattagcacattaattttatttgactggcgagaggatgttcgccagtccatttttatgaacaaggacacagtatgaaagaaattattctctcctccggtattggatttggtattggcgcattttttactttatgccgtatacctattcctgcaccaaatgttttacccggggttttatctattgtatttatgtatattgggtatcttgtcgttaaatctattttttactaggtaatatggtaaattccagacgttatcccttattcctggagtgcgatagtgatggaacgagcccatcgtattgatctaaagctattacgttatttcctcgctgttgcagaagaattgcattttggccgggctgctgcccggttaaatatgtcacaacctcccttgagtatccatatcaaagaacttgaacagcaactgggtacattgctgtttattcgtcattcccgcagcgttgcattaacccatgccgggaaagttttaatggaggagtcacgtcgcttgttagccaatgcaaatcaggcgctggcgcgagtggagcagattggtcgcggtgaagcggggcgcattgaactgggtgtggttggtacggcgctgtggggaagaatgcgtcctgcgatgcgtcactttttgaaagcaaatcccaatgttgaagtactttttcgcgaaaagtctccaggtatgcaaatggcgttgttagagcgtcgggaacttgatgcagggatctggcgtatggctatcgaaccagcagtcggttttaccagcatacgtttgcatgaatctgcattcatggttgcagttccggaagatcacgatctggcatccagagattctgtgccgctgtcggcgttgcgcaatgaatattttgttacgttgccttccgtacattctgattggggatttttacaacgtgtatgccaacaggcgggtttctcgccaatgattattcgggaagtggttgagccgcaaacggtgttggcgatgatcagtatggggatcgggattacgttgatggctgatggctatgcgcaaatgagctggccgggtgtggtgttccgtccgttagaggaacgtattccggcggatttgtatattgtgtatgaccagcagcaggcaacgccagcactggagaaactggtggcggcgttgacggtatgatgtctgtgccggatggcgactaacgtcttatccggcctacgcggcggtgtcgtctgtaggcctgataagcgcagcgcatcaggcaagacccgaacctgcggcaggttcgaatcttataaatcgcagatagcaaaaaagcgcctttagggcgcttttttacattggtgggtcgtgcaggattcgaacctgcgaccaattgattaaaagtcaactgctctaccaactgagctaacgacccgaagtggtgggtgatgacgggatcgaaccgccgaccccctccttgtaagggaggtgctctcccagctgagctaatcacccacttcggtacttcacaataagaaatttagctggcgagaaagtggtgggtgatgacgggatcgaaccgccgaccccctccttgtaagggaggtgctctcccagctgagctaatcacccacttctcaatttcttatctacacggcggagactacataaagtagttggtgggtgatgacgggatcgaaccgccgaccccctccttgtaagggaggtgctctcccagctgagctaatcacccccgctgtgtggagtcgcattatagggagagttgaaaatgagtcaacgcattttctaaagtttttgtttgttcgtcgtaaaattaaacaaaacgatcgtgaattaccccgcactgcatgatttctatacggaaatagcaaagcgcagcgttctgaccggatcaacattgaggaatcaagccacagtgatagaatacaaggctattcatctttccaggatttgccggttgtcggcatctttataaacgtaaggccatttcatgaaaatcaaaactcgcttcgcgcctagcccgacaggttatctgcacgtcggcggcgcgcgtactgctctttattcctggcttttcgcacgtcaccacggcggtgaattcgtgctgcgtattgaagacaccgatcttgagcgttccacgccggaagccattgaagccatcatggatggtatgaactggctgaacctggaatgggacgaaggcccatatttccagaccaaacgttttgatcgctataacgcggtgattgacgagatgctggaggcgggaacagcctataaatgctactgctctaaagagcgtctggagcaactgcgtgaagatcagatggcgaaaggcgagaagccgcgttatgacgggcgttgccgtcacagccacgaacatcatgccgacgatgagccatgcgtggtgcgctttgccaacccgcaggacggttccgttatttttgatgatcagatccgtggcccgatcgaattcagcaatcaggaactggacgatctgatcattcgtcgtaccgacggttccccaacctacaacttctgtgtggtggtggacgactgggatatggaaattacccatgtgattcgtggcgaagaccatatcaacaatactccgcgccagattaacattctgaaagcgttaaacgcgccggtgccgatgtacgcgcatgtgtcgatgattaacggcgacgacggtaaaaagctgtctaaacgtcacggtgcggtgagcgtgatgcagtatcgcgatgacggttatctgccggaagcgttgctgaactatctggtgcgtctgggctggtccagcggcgatcaggaaatcttcacccgcgaagagatgatcaagctgttctccctcggtgcggtgagcaagtctgcgagcgcgttcaacaccgataaactgctgtggctgaaccaccactatatcaatacgctggcgccggaatatgtggcgacgcatttgcagtggcatatcgagcaggaaaatatcgacacccgtaacggcccgcagcttgctgagctggtgaagttgctgggcgaacgctgcaagactctgaaagagatggcgcagagctgccgctacttctatgaagacttcagcgagtttgacgccgatgcggcgaaaaaacacctccgcccggtggcgcgtcagccgctggaagtggtgcgcgacaagctgtcggcgattacggactggtcagcagaaaacgtccaccacgcgattcaggccacggcggatgagctggaagtggggatgggtaaagtagggatgccgctgcgtgtggctgtgaccggtgccgggcagtcgcctgcgctggatgtcaccgtacatgcgattggtaaaacccgcagcattgagcgtatcaacaaagcgctgggctttatcgccgagcgtgaaagtcagcagtaacgccagctgaaacagaataaacggcagggcagacgcctgccgtttattatttgttagtccgcctcattgatacctaaacgcgtcagaaatccgcgaataccttcccgcgataaaaacagcgccagtttttcctgttcctgagcagacatattttcaacggcatcaataatttgtcgataagcgtgactgtgcgtcgcgttcgcatattctgcgaaagcctcttccgcctgataaaacgcaggcagtttgcgaaaagccggaatattgagaataaactcccgcacgctggcatcaatatggatgagtcttgcgcgtccgcctttgacgccgggaaatttttcggttttccagtgttgttctctgatccagcgattgacggtttgtctggccacgccgaggcattcagccagctcttcagtggtcattttactgcgtaatcttttcatattatttgctatcgcgtatccctaagcgttgtaacaaaccggtaatcccttcacgcacgaggagagaggtaaactgtttctgctcggatgaggtcatctctttggcgagcgtcatgagcagcgcttcaagcgatgcgttgctggcaggcgtgaatgtgtctgcgtgatggtcaactgaacgttcagcgctgcggatatattcacgaacctgttcgtttacatgaaccagacgggctttaccgccctggacgccaggtttgggcgatgttgcccagccttctttccgtacccatttattgatggtttgtcggctgtaaccggtgagattagcgagttcttctggcgtcatccgttccttgaacataacgattccctgaatagtcgtggggttaattagtggttcattttatagcaccattttagtcgaaaccgtgacgtgtttaactactgaatgcgagttgtgccgcaatgtcctttatttgaatgctttttcagcgattgaattcggcaagttcattttgccgttgacacatgccgagggaattcatatgatgccgcccgtcaactcgacaagctttacgtagtggggctatagctcagctgggagagcgcttgcatggcatgcaagaggtcagcggttcgatcccgcttagctccaccaaatttactcccgataaatttggcgtatacgtaaaagcactatggggctatagctcagctgggagagcgcttgcatggcatgcaagaggtcagcggttcgatcccgcttagctccaccaacgttcaaaccctcgctgaaaagcgggggtttttgctttttgtcacaaaattcatggcgtctgatctgctcttcaggtgcgttcgtttgccgctgcttttgcggtcaatatgagcttttgttagattgcttcataatgcgaatatacttattattcatgcgccttatataatgatgtgagcattaaagcaatgccggataagtgtaacgtattaaaaaatataaaaatattcttactggccttctgcctgaccgttccggctattctgctatctcgtctcatttctccccgcgccacaattgattccagctatatctttctggcctggctaccgctctgcgtcatgttttccgtgctgtttttatttggccgccgtggcgtcgcgccgatggtaggcggaatgatgttgactaatgaatggaattttcatttacctctgccacaggcgatggtgctgctattttgccagacgtttcccgtgttgctggtttgcgctatcgtacgctggcagctgggcgcgcgctggcgctacggaatacccaaccaaggcatctggctacgcgttttctggttagggttaatgacgccgtttggtataaaaatcagtatgcatctggcggggcactacctggctttcccggtgaccatctctaccttctttggcaccggcaccgctattttctcgattgtcgatttattgagtctgatttctgccgcgcttatttttaccctctttttctattatccgctgcgaatgatagtcagcccgcactatatgcgtattttctggcggagggatgtcgctccttatctcgccaaagaaaaacgcctgtttacgcttctctggtttgccactctggcgacgctattagcggtgctgtgtacgcctttcgagacaaagtatattgctggctatctggtgccagttctgttcattggatttaccatcggcgtggggaaaatcagctatccgctgttgaattttagttgggctctcactgcgctattcctgcttagctataaccgcaattttctgcagggcgtgggttcagaatattcgctggcatttatcctttcagttctcatttcttttagtatttgtttgttgtacatggcgcggattaatcagcgtagcgaatggttgaatcgacagtggcactcgcaggcattgaccgatccgttgacgcaactgcctaacttgcgcgcgctggggcagtttcttttacaggatgccgggcaaagcgtgtgttatctacgcatggaaaacctggaatttctgagccgtcattacggtatgcagatgcgcgtgcattgcgaacgcgaggtgtttcgcgtgttgcagccgctgctgctggaaaaggagaaaattttccatctgccgggcagtgaattattgctggtattgacgggaccggagacggaagcccgcctgcaatatatgctcaatgtgcttaataaccgcaaaatttactggaacaataccggtctggacatggaatacggcgcatcgtggggaacattcgatggtcgccaggaaaccttgcaaccgctgttggggcaattaagctggctggcggagcaatcctgctcgcaccgtcgggtgcttgcactgacccagagtattgaagccgcttccgggcagacgacggaacgggtgctgcggttgcagaaaatccgtcaggcgctggagcgcggcgcgctggttttgtatgcgcaacccattcgcgacgcgcagggaaaagggtatgacgagattctgacgcggcttcggtgcgacgacggtatcatgatgccgaatcagttcattccgcttatcgcccagtttaacctgagcgtacggtttgatatgcaggtgatggaagcgctcctgcaatggttgtccgcgcatccttcggcggagcagggggcgcgtttttcggttaatttgatgccgctgacgctgctgcaaaaagagacggcgtcgcgcattatgcagctttttaaacgctatggcgtcccgcctgcttcggtcatcatcgaaattactgaagaacaggccttctctcattccgaaatcagtatgcacaatatcaaccagctgcgtaagtttggcctaaaaatcgccattgatgatttcggcaccggttatgcaaactatgaacggctaaaacgcctcaaggcggacatcattaaaatcgacggttgtttcgtaaaagatattctgacggactccctggatgcgatgatcgtgaaatccatcactgatttagcgaaagcgaaatcgttgagcgtcgtggctgagtttgttgaaacgcctgcgcagcgcgatctgctattgcagcttggcgtacatagtttgcagggatatctgattggccgcccgcgcccgttaggcaaataagcggcataaaaaaaccggggatagctccccggtttctacattaaacgcagacttacagtaccagcgccgcgatagaggcggacagtacgctcaccagcgtagaaccgtaaaccagtttcagaccaaaacgggaaaccacgttgccttgctcttcgttcaggcctttaatcgcgcccgcaataataccgatggaagagaagttcgcgaaggacaccaggaagacggagataatgccttcagcgcgtggagagagggtagaggcgattttctgcagatccatcatcgccacgaattcgttggaaaccagtttggtcgccatgatacttcctacctgcagcgcttcactggacggtacgcccattacccatgcgaccgggtagaagatgtaacccagaatgccctggaaggagatgctgtagccgaaccaaccggtaaccgttgcgaacagcgcgttcagcgccgcgatcagcgcgatgaagccgatcagcatcgccgcgatgataatcgccactttaaaacctgccagaatgtactcgcccaacatttcgaagaaactttggccttcatgcaggttcgacatctgaatattttcttcgctggcatcaacggtataggggttgatcagcgacagaacgataaaggtgctgaacatgttcagaaccagcgctgcgaccacatatttagggtccagcatggtcatatacgcgcccacgatagacatggaaacggtagacatcgccgttgcagccatggtgtacatgcggttacgggacattttaccgagaatatctttataagcgataaagttctcagactggccgaggatcagcgagctgacggcgttaaaagattccagtttgcccataccgtttactttggatagcaggaaaccaatagcgcggatgaccactggcagaacacggatatgctggagaataccgatcaacgcggaaataaagacgatcgggcacaatactttcaggaagaagaacgccaaaccttgatcgttcatactgccaaagacgaagtttgtcccttcgttggcaaatccgagcagtttttcaaacatctcggagaaaccttttacgaagccaaggccaacatccgagttcaggaagaaccaggccagtaacacttcgataacaagtaactgaatgacgtaacgaatgcgaatttttttacggtcgctgctaaccagcagtgcgagtaccgcaacaacggcaagcgccaggacaaaatgaaggacgcggtccatatttgctccaaatatgaggcaggtttaattttcgtgcacattctatgcaacagctgtaaagaaaacgagatccaacacacactataataaggacctgtgacgagattcaaaattagtgatctgtaatacacttttactgtactgaatatgaaaatgaaaagttatatcagtgtgctaatcttgtaatgttaagccaaactgttctgatacaggtcgccatcgtatcggtctatcgtttcacactatcaaagtaatcacccgtacccattgaaatgcacttgataatcattatcaatgaacatagcatgaaacatagcaaaggctatgtttttgaggcaaaagatgactgacaatcgcgtagagaatagcagcggacgggcggcgcgcaagctaaggctcgcattaatgggacctgcgttcattgccgcgattggttatatcgatcccggtaacttcgcgaccaatattcaggccggcgccagctttggctaccagctactctgggtggtggtctgggcgaacctgatggcgatgctgattcaaatcctctcggcaaaactcgggatcgccaccggcaagaacctggcggagcaaattcgcgaccattatccgcgtccggtagtctggttttactgggtacaggcggaaatcatcgcgatggccaccgatttagctgaatttatcggcgcggcaataggttttaagctgatcctgggcgtctctttactacagggcgcggtattgaccggtatcgcgacgtttctgattttaatgttacagcgccgcggtcaaaaaccgcttgaaaaagtcatcggcggtttactgctttttgtcgccgccgcttacattgtggagctgtttttctctcagcctgatatggcgcagctcggcaaaggaatggttatcccggcgctaccgaacccggaagccgtattcttagccgccggcgtgcttggcgcgacgattatgccgcacgtgatttatctgcactcgtcattaacgcagcatctgcacggcggaacgcggcaacaacggtactcagcaacgaaatgggatgtcgctattgccatgacgattgccggttttgtcaatctggcaatgatggcgaccgccgcggcggcgtttcattttagcggccatactggcatcgccgacctcgatcaggcatacctgacgctggaaccgttactaagccatgcggcggcaacagtgtttggtcttagtctggttgcggcagggctttcctccaccgtggtagggactctggcggggcaggtggtgatgcaagggtttgtccgttttcacattccgctgtgggtacggcgcaccattaccatgctgccctcatttattgtgattttgatggggctggaccctacccgaattctggtgatgagccaggtgctgctgagttttggtattgcgctggcgctggtgccgctcctgattttcaccagtaacgctacgctaatgggcgagctggtgaacacgcggcgggtaaaacagattggctggataattgtcgtgctggtcgtcgccctgaatatctggttgctggttggaacggtgatggggttgtcataaagacagaaagatagcaggcccgatgcgtgggcgtcatcgggctgttattcagcaggaggcttagtgatgatgtttgtgaccccggcctcgcccgcgatgatcgtcgcgatcgcgccagccttcccgataaccgcgttcatacgctttacgcttatcccagccgcgatgatagccgttgtcatggcgccaccagcgatttttacgccattcataatggttgtgccagtaatcccggtcgcgccagcgaccaccgtcccagtagttaccgtaatcatcgcgatcgccaatctgtaattttattgagggcaacagggtgatttcgcccgcattcgcggcaagcggtgtaaaagccagcaaggctgccgccagaatcagtgacctgaacatactttctctccttcacgatcgagccgtcgccggcctgttaatgcaatattacaaagcagtaaagatttgtttcatcgccttaactcttaaatcatgaaggagagcattttttgctaaaaccggccctccagaatagcgtcaatttctgcacattccgccgccgaaaaacggcgattggccagcattcctacggcgtcttcgatttgcgacggtttgctggcgccaatcagtaccgaggtaacgttatcgttacgcagcacccaggcgagcgccatctgagacaatttttggccccgtcgtgcagccagttcattcaaccggcgaactttttccagtttgtcggcggtaatctgttctggtttaaggaaacggcttccgctcgccgcgcgggaatcttccggaatgccattcagataacggtcagtgagctgcccgcccgccagcggcgagaaggcaatactgccgacgcctttttcctgcaacagcgtcagcagcccgtcctctacccaacgctcaaaaagcgaatatttaggctgatgaatcaggcaaggcgtgccgagatcctccagaatatcgatagcttgtctggccagatcggcaggatagttagagatccccacgtacaacgctttgccgtggcgcacaaggtgatctaacgctttcatcgtctctttaagcggcgtttcgggatcgggacgatggtgataaaagatatcgacatactccagccccatacgtttcaggctttgatcgaggctggcgataaggtatttccgtgaaccccagtcgccataagggccatcccacatggtgtagcccgctttggtggagatgactaactcatcgcgccacggtaaaaaatcttcctgcagaatgcggccaaaattgcattctgcggagcccggcggcggcccataattattggcgagatcaaagtgggtaatgcccagatcgaacgcgcgttgcagcagcgcccggctattttctacccgtgtcgtatcgccgaagttgtgccataaccccagcgaaatagcgggaagtttgacgccgctgcgcccgcagcgacgatactccattgtgtgataacgattctcatcgggctgataaatcatgacctttccccctgtggcgtgaataaatagtgtatacggttacactcgccaggcggtatccggcttttactgtttgccgctgtaaacattgttttccaggctttcatccccgccgtgctggacagccatcggcattccttaatactcaacataatgtcaacgtcagaaggaaagctgtcatgcaaaacccctataccgtggccgactatttgctggacagactggcaggatgcggcattggccatctttttggcgtaccgggcgattataacttgcagtttcttgaccatgtgattgaccacccgaccttgcgttgggtgggatgcgccaatgagctgaacgccgcttataccgcggacggttatgcgcgcatgtcgggcgctggagcgctactcaccacctttggcgtgggagaacttagcgctattaacggtatcgcgggcagttacgcggaatatgtcccggtcttgcatatcgtcggcgcgccctgtagcgctgcgcagcagcgtggcgaattgatgcaccataccctcggtgacggcgattttcgtcatttttatcgcatgagtcaggcgatatccgctgccagcgcaatattggatgaacagaacgcctgtttcgagattgaccgcgtattgggtgaaatgcttgccgcacgcaggccaggatacatcatgctgcccgccgacgtggcgaaaaaaacggctatcccgcctacggaggcgctggcgttgcccgtgcatgaagcgcaaagcggcgtggagacggcttttcgttaccacgcccgtcagtgcctgatgaacagtcggcgcattgcgctattggccgactttcttgccgggcgttttggtttacgaccactgttgcagcgctggatggcggaaacgcccatcgctcatgcgacactactgatggggaaggggctttttgatgaacagcacccgaacttcgttggcacctatagtgcaggcgccagcagcaaagaagtacgtcaggccatagaggacgccgatagggttatctgcgtcggcacccgttttgtcgatacccttacggccggatttacccaacaattgccggcggaacgcacgctggagattcagccttacgcgtcgcgcatcggcgaaacctggttcaacctcccgatggcgcaggcagtgtctacgctgcgcgaactgtgccttgaatgcgcttttgcgccgccgccgacgcgttccgccggacagccagtgcggattgataagggagaactgacccaggaaagcttctggcaaaccttacagcagtgtctcaaacccggcgatattatccttgtcgaccaggggaccgccgcctttggcgctgccgcgctgtcgcttcctgacggcgcggaagttgtggttcagccgctgtgggggtctatcggctattccttgcccgccgcgtttggcgcgcaaaccgcctgccccgatcggcgggtaattctgattattggcgatggcgcggcgcagctcacgattcaggagatgggctcgatgttacgcgacgggcaggcgccggtcatcctgctgctcaacaatgacggctataccgtagagcgcgccattcacggcgcggcccagcggtataacgacatcgcgagctggaactggacgcagataccaccggcgctaaacgcggcgcaacaggcggagtgctggcgggtgacgcaggctatccaactggcagaggtcctcgaacggttggcgcgcccacaacgtctgtcatttattgaagtgatgttgccaaaagccgatctgccggaattactgcgtaccgtgacccgggcgctggaagcccgcaacgggggataatggcccccgctgcgccggattagggttcgtgacggttggcggccagcaacggttttcccgccagcaatagccaggcggggagcatcacaatgcagagcagcggcagcagattggtatccggtacgacgactgccgccataaacagactgagccagccgtcgcgcgtcactaccagcactaagccaagaatcgcgcaggagacggtaatcgccgcgggtacggcctcaacatgggcatggagcatgagccccagcgccgcgccgataaacacagccggaaaaatgcgcccgccgcgaaagccgctcgccgccgcgatgaccagcgcggcgagtttgacgacggctaaggtaaaataatctcccgcgcccaacgtctggctaaacgccatttgttgcatttcgtccaggcctttaaacagggtaagcggcccgccaatgacgcccagaatacccagtataaaaccgccaatgccgagaatcaggaccggattttttagtcggtgcagcaactcgtgcagacgcggaaggcaccagacggcgaccatcccggcggcaatggcgatcgccgcgacgatcgctccgctggcaatgtccaccagccgcatctgcgtgtaatgggcgatgggtaacgaaaaatgcggatgaaagaacaggctggtggtgagtgaccccgccgctgccgccattaacggcgcaaacaggcgatcccacatgggaatatcgttagagccgctaagcgtttgcgaaaaaatcagcgccgcggcgacgggcgtgccgaacagcgcgccgatggtgcctgctgaggccagaatcgtccagtctaacgccgtgatacgcggaaacaggcgggagccgaaagccgccgccagcgcgatatttattgtcattatcggatgctctggccccaaacttaccccaccagcaaggccgatgattaaggcgagaagcagcccgggcagcgcagatggcgagaccggcatactgattaacggttcgatggccggatcggggccagcgtgtccgggactgtaacggataatcaaacccaccacgatcccggttagcgtgagcatacccactatccagaacggcgaatcataagcgattccgatgctggcgggcagtcgttgccaaagaaattgctgaaaaaccgacgcgactttcatcgaggcgattaaaactaggcttgacgctacgccaataatcagcgcagggagcgacagcagcagcatcgttcgggcacgcgggtggaacataatctcttccttacacggggtcgtatatctattttgcacagcctgcccgacggcattgctgcaattggtgctgaaacaagaaagtaattctgtgatgaagatctatatttataggcagtcagcctgatggccgttgttgttatgcccccatgaatttacagtgtgacaaagacttattttgactttagcggagtagtagaagaatgacaaagtatgctttagtaggagatgtaggcggcacgaatgcgcgtcttgccctgtgtgatatcgccagtggagaaatctcgcaggccaaaacgtattccggcctggattaccccagtcttgaggccgtggtgcgcgtttatctcgatgagcatggcgtcagcgtggaagatggttgtatcgccatagcctgcccgattaccggcgactgggtggcgatgactaaccatacctgggctttttctattgcggaaatgaaaaaaaatctcggctttagtcatctggaaatcatcaacgatttcaccgccgtgtcgatggcgatcccgatgctgaaaaaagagcatttaattcagttcggcggcggcgaaccggtagacggcaaacctattgcggtgtacggcgcgggaaccggcttgggcgtggcgcatctggtgcatgtggataagcgttggattagccttccgggcgaaggcgggcatgtcgattttgcgcctaatagcgaagaagaagctatgattctggaaatattgcgcgccgaaattggccacgtttccgccgagcgcgtgctgtctggcccggggctggtgaatctttaccgggcgattgttaagtccgacaaccgtctgccggaaaatctgcgcccgaaagatattaccgaacgcgccctggcggatagctgtatcgattgtcgccgcgcgttgtcgctcttttgcgtcatcatggggcgatttggcggcgatctggcgttaaccatggggacatttggcggcgtttatatcgctggcggcattgtcccgcgcttcctggaattctttaaagcgtctggcttccgtgggggctttgaagataaaggccgctttaaagattatgtacacggtattccggtctatctgattgtccatgataatcccggcttgttaggctccggcgcgcatctgcgccagacattaggccatattctataagtcagacggcggcataaacgccttatccggcctacaaaagtgtgtcatctgtaggcctgataagcgcagcgtcatcaggcaatgaaacattctcttgtcagtctcaaaccgcgtgcctcacgcggttttttttcattgccgttcctgtgtatgaatacttcaactgactgaattatttcactttactcttgctgagcgaaaagtcaaacaccagcgcgttgagtcatcacgtcatggtgattactcaggcgaaaacagggatttattttactgtacgtatccggttcgctgccttatttacgctttcatcgcggcagcttgccggaaaggatccttattttcggggaaatatccctgaaaaataccgcaatatgacatgaacgaataccattatcgttagtaaggcttttgattaaagaggaaaaaccacaaaatcaaaaggggattatttgagataaggtttattgacaggaaattatcgtcggccataccgcgttaggtaaattcaatgatatcaatttgttaatgatgtgatttatttggtgctataactgacacgcttaaaaagtaaatttttacggttgttcctctttttcgtcgctaaaaaatattttcattagcctctcgacaggaagaaaattttcaggctattttctaaaggagccaccatcgtggcagcgtcgctcggacggtccgggcgctaacgttaatctgaggatattatggctgactcccgccctgaacgtcgctttacgcgtatcgatcgccttccgccctatgtttttaacatcaccgctgaactcaaaatggctgcgcgtcggcgcggcgaagatattattgatttcagtatgggtaatcctgatggcgcaacccctccccacattgtcgaaaaactttgcaccgtcgcgcagcgtccggatacgcacggttattccacgtcccgcggcataccgcgtttacgccgcgcgatttctcactggtatcaggaacgttatgatgtcgatatcgatccggaaaccgaagcgattgtgaccatcggttccaaagagggactggcgcatttaatgctggcgacgctggatcatggcgatacggttctggtgccgaaccccagttacccgattcatatctatggcgccgttatcgccggggcgcaggtgcgttcggttccattggtagagggggtggatttcttcaacgagctggagcgcgctattcgcgaaagttatccgaaaccgaaaatgatgattttgggttttccgtctaaccctacggcccagtgcgtcgaactggaattttttgaaaaagtggtcgctctggctaaacgttatgatgtgctggtggtgcacgatctggcgtatgccgatatcgtgtacgacggctggaaagcgccatccattatgcaggtgcccggcgcgcgcgacgtggcggtcgaatttttcacactgtcgaaaagctataatatggcgggctggcgtattgggtttatggtgggcaataaaaccctggtcagcgcgctggcgcgcattaaaagttatcacgattatggtgcttttaccccgcttcaggtggcggctatcgccgctctggaaggcgatcagcagtgcgtgcgcgatatcgccgagcagtataagcgtcgtcgcgatgtgctggtgaagggactgcatgaggcgggctggatggttgaaatgccgaaagcctcaatgtacgtctgggcgaaaatcccggagcaatatgcggcgatgggatcgcttgagtttgccaagaagctgctgaatgaggcgaaggtttgcgtttctccagggataggctttggtgactatggcgacacccatgtacgctttgcattaatagagaatcgcgatcgcattcgccaggccgtcagagggattaaaacgatgttccgcgccgatggcgtgctgccgtcacatccaaaacccgttgaagcgagcacggagtagaaaagcaaacaggagccccatggctcctgttttttgtctatggaaaacccccagctaggctgggggttccggaaagctttcagctttaagccagttattaaaaccccttttgatttgttaaaacatcttgcggtctggcaactgcaaaagttcaacaagaaatcaaaagggggtcccaatgggggacgaaaagagcttagcgcacacccgatggaactgtaaatatcacatagttttcgcgcccaaataccgaagacaagcgttctatggagagaagcgtagggcagtaggcagcatattaagaaaattgtgtgaatggaaaaacgtacgaattctggaagcggaatgttgtgcagatcatattcacatgcttctggagatcccgccgaagatgagtgtgtcgagtttcatgggatatctgaagggtaaaagtagtctgatgctttacgagcagtttggggatctaaaattcaaatacaggaacagggagttctggtgcagagggtactatgtcgatacggtgggtaagaatacggcgaagatacaggactacataaagcaccagcttgaagaggataaaatgggtgagcaattatcgatcccgtatccgggcagcccgtttacgggccgtaagtaacgaagtttgatgcaaatgtcagatcgtatgcgcctgttagggcgcggctggtaagagagccttacaggcgcatcagaaaaacctccggctatgccggaggatatttatttgcattgtacttttaaatcatcagggcgaaagtaccggcccaaacgatgaccataaatgaaatgcccataaagaaatatttcacgtttcatctctccgcgtacctgtcgtacgcctaaatgaacttacacttacctgattatagagagttgatgccggataatacgaaattgagaattattcgtgtttcgaccgcctgcatcacctcagaattctgcgcgtcatcgctccagacggcgctaatgtacgcctaaaaatgaggtgaaacaagaggcattttcttatttatttttagtaacttacaagtgtcgtgaatcggcgacagtttaatttctgacagtgatgaatcgctattgagcgacgccgccgacacagtaaaaaaacgcctgtaaacaggagacttatcgctaaaagcaggaatgagtaatttacgatgtgaatattatggcaatgcgaaatgacaaaataaaaggccttgcggcctttttcagatgtagagtgacgcttcccccaacgggcgagtcttgaaacggcgatgaatccagagatattgctccggggcgcgcatgatctctttctcaataattttattcatataggcagcggcttgattttcatctgccgggtaaccttccatttcaggggtaatatacagacgataacccgagttatcggatttccttaccattgtaacggtcagcatggcggcgccagacagcctggacagtacataggtaccgttggtggtggcgacgttttcaaccgcgaaaaatggcgcaaaggagctgcctttaggaccgtagtcctggtcgggagcaaaccaaacggcttcccctttttttagcgcgcccacaatgccgcgcagattgtttctgccgatcatcgctttatttgagcgcatacgaccgcgcgtctgcacccactccatgagcggattgttatgcggacgataggtcgccatcatcggctggcagagacccattacccggcctcccaattccagcgacataaaatgcacgccaacgaccattacgccgcgattttgcgcctgcgcacgggtaaggttgtccagcccgtccacatcaaaccatttgcgaacccggctatcaggccagaaccaggccatgcccgtttcaagcagcgccatgccaagagagtggaaattctcggcgatcagtttttccctttcttcccgggagagggtcggaaaacagagttcaatgtttttctgagcgatcgactcacgtcgcttcaggaaggggcgcgccagcttaccggtgcgggtgcccagaaaacgcaaaaccgggtagggaagctgcaccagtaaccagaggacgccaacgccaaaccacgtcagccagtagcgcgggtgcaaaaacgcgcgtgaaaatttgctttgaggaaacataaaataccttctgtagatacgaaaataatgtatcgcagaagagtcattatccgcagcggtacactctgaaatacgcatcatccttcaagttgcgttcgcttatccgaagcacttacttgagtaagctcatcagggtaacttgaatgatttgcgtatagttaggccatcatgtacgacaatggttcccgtaaggagtgtaaaactaagtcagtactaaaccacgagggcatgaacgccaggcaggctaatgtaccaccagttatttactcgcgcccagaaattctttatcaagaagcgtaaatatttctcccgtagcaaaaataagctaatcattatttttaatgcattgtttttacagtgataattttatttcagacgaaggttattgaaaaatgattagaaaataaaatgtgagataaatgttatggaaatgacgtgctgataaggtttatcttaaaggagaagtgagagggaccgtaaggctatatggaagccttgccatagacaggaggtattatagatgatctatttatggacatttcttgcaataagtatacttgccgtgagtggctatatcggtcaggtgatgggggctttttctgcggtttcttcttttacgggaatggttatccttgccgcgctgatttatttactcaatgtatggctgcaggatggcgatgacatcgttagcggattattgctttttctcgcaccggcatgtgggttaattattcgctttatggtgggatacggtaagcgttagtcagtacatacctttcatacttcaagtggcttatgtgttggctatggattactcggcccattcatgggcctcgccctgacgggacgtcgctcaccccagtcacatcgttatctatgctcccggggactcactcccttgccgcttttaagcaactcgaattatttttggtatacacgatgtcagcgaatagatagcgccgacaatgtcggcgcttctgttccccgggaaggctaatcgtttattgcgcgtccgcaagctgcagtgagtcctgattatgtaacgcattctggcgctggcgttccagttccagcgcgccgcgatgggagaggtaacagaatagaatgcagcacacgatgccgcccatcagaagataaaatccgccgtaccagcccagtttatccaccatgacgccaaacaggctggtgcccaacgaggcgccgaaaatatagctcatgaacccacgtaaaccgacggcggaacctacggcaaagctggggactatctccattgtctgtacggacgcgaggaattgcgggacgtaaatcagacaacctacaatggcggcgaaaatcgttaccatcagcaaagattcacttttccagtatccgatcagacagacaaaaatcagcgccatgcaaatcatggctaacggcattctgcggcccttaaacagtttatctgacagccagcctgccagtagcgtagagggaattgccgcccactcgaaaaagagaaacgcgacgctcatctgttcttttgaaaagtgttttactgtcaacagatagataggcaaccagctaatcatgccaaaccgcaccatatagacgaagacatcgaccagcgaaatataccaggcatttttattgcgcagcacataagtacagaagatttgccatgcgctcatattttccggcgcttttgccgtattcttcgttttcagtatgactttttcttccggcatcatctgttccagggagggaagaccttcttcgcgcggcgaaccttttcccaagaccagaacaattaaggcaaaaatgacggcgacgcaggccggaacgatataactggcgctttgccagtgttcgctgcccaatatcgcaaaagccgcaccgacgataggcgcgacgatcccgccgccaacgttatgcgagatattccagaaggcgcctacgcgtccgcgttcccgacgagggaaccagtttgcaatagtaataaacgaggggccgacgcccatgccctgaaaaaggccattgaagaccaccagagcggcaaatatccagaatgcgctactgaatcccagcccaacgttaacaatcacgcagagtaccagaccgcacgccatgaagacttttgggctggctttatccgccagactgctcattacgcctttactgattccgtaagcaataagcatacagctactcagcaggccgatttgcgtagcgctgagatccaattgctcttttaaataaggcgtcgataatgtgaagttgtttctgactatatagtaagcgagatatcccagaaatacgcttaacaatgcctgtatacgatatcgaccatacgtagcctggactttttccggtgggactttatgcgccgatcgccctgtttttaatattgttaacatggagtcacctgtattttatagtgagatgaacatcaggaggttttgtcggtagagtgaaaggagtgacaataaaattcaagtcgaggaaatgtgtcaaaattgactcaattgggtgaatttaaaggttatttttgacccatcctgaagggtgtggtgaaactttaattattggcatggccgttttatcgttagcatgtgcggatattaacaaatttgctgccagtgatctgatacgctttattgatgttttcgggcgacggacccgttattattcaaataacgttgttctggatgccaacagaaataaaagggtaagttttgtctcaatattttctttatgtgatatcgatatttatgaacgggatcacaaatcgacttttctcatactgtggttgtttcgccagagtgggcgcttttacgctatggctggcggcgatgttcggttcttgccaggcgtacagccgcgagctggtgatggcaacgaccttttcacccagcgcgaccgcctggattatccagcgctggcagacggagccgggttccgtcatgattcgtacgctcaaccgtaccagcggttctttagagcaattacttgatacggcgaatgcggaaaatgtcgatctgatcctgacgtcatcccccatgctgttgcaacaccttcaggagcaccaaaagctggcgctattggatagcgcgcctgccgccagccagaagctggtgccgcgttctatccgctcaacttcagtggcggtagcggtatccggatttgggctattgatcaaccgttcagcgctcgctgcgcgccatcttccgccgcctgccgactggcaggatatgggcctgcccagttaccagggcgctctattaatgagcagtccgtcacgctcagacaccaatcatttgatggtggagtcgctgttgcagcaaaaaggctggacggcagggtgggcgacgctgctggcaatctcgggtaatttggtcacgatttcctctcgcagtttcggcgtagcggataaaatcaaaagcgggcttggcgttgccgggccggtcattgataactatgctaatttgctactcaacgatcctaatcttgcttttacctattttccgtattctgcggtgtcgcccacttacgtcgcggtgttgaaaaacagccgtcatgcagacgaagcgcgtgcttttattcattacttattaagtccgaaagggcaaaggatactggctgacgcgaataccggtaagtatcccgtcgcaccgcttagcgccgataatcctcgcgccgcgcaacaacagcgtttgatggcccagccgccgttgaactatcgtctgatcctgaagcgtcagcaactggtacaacgcatgtttgataccgcgatcagttttcgtcttgcgcagcttaaagatgcatggcgagcgttgcacagcgcagaaacgcggcttaaacgccccttacctgaaatcagagccttattgaccagcgtcccggtggatgcggcaagcagcgaagatgaaacctggctggcgcagtttgataataaaagctttgccgaacaaaaaatgatggagtggcagatctggtttctgaacaatcagcggctggcgattcacaaactggaagagctgaaatgaaggggagattattgcaacggcttcgtcagctcagtatcagcaacagtttacggggtgcatttttaacgggcgcattactgacgctgattgtcagtatggtcagcctttattcctggcatgagcaaagttcgcaggttcgctattcgcttgatgaatattttcctcgcatccactccgcttttttaattgaggggaacctgaatctggccgtggatcaactcaatgaatttttgctggcgccgaacacgacggtacgtttgcagttacgtacgcagattattcagcatctggataagattgagcgtctcagtcaggggcttcagcttgctgagcgccggcaactggccgtcattttacaggatagccggaccttgctggcggagctggacaacgccctctacaacatgtttttggtgcgggagaaagttagtgagctttccgctcgcatcgactggctccatgatgatttcaccacggagctaaattcgctggtacaggattttacctggcagcaagggacgctgctcgatcaaattgaggcgaatcagggcgacgcggctcagtacttgcaacgttcgcgcgaggtgcagaacgagcagcagcaggtatataccctggcgcgaattgaaaatcagattgttgatgacctgcgcgacagattgaatgagctcaagtccggcaataatgacgggatgctggtggagacccatattcgctatctggaaaacctaaaaaaaacggcggatgagaatattcgtgcgctcgatgactggcccagtacgatcacgctgcggcaaaccatcgacgaactattggaaatcgggatggtaaaaaataagatgcccgataccatgcgcgattatgttgcggcgcaaaaagccttactggacgccagccgcgccagagaggctacgctagggcgctttcgcacgctgcttgaggcgcagttaggtagtagtcaccagcaaatgcagacgttcaatcaacgcctggaacagattgttcgcgttagcggcgggcttattttagtgacgacgctcctggcgttgctactggcctggggactcaaccactattttatccgttcccgactggtgaagcgttttaccgcgcttaatcaggctgtggtacagatagggctggggagaaccgactcgactatcccggtttacgggcgcgatgagctaggacggatagcccgcttgctacgtcatacgctgggccagctcaatatgcaacgcaggcagcttgaacaagaggtcgccgagcgcaaagagatagaagccgacctgcgcgccatgcaggatgagttgattcagacggcgaaactggcggtagtcggccagaccatgaccacgctggcgcatgaaattaaccagccgctgaatgcgctttcaatgtatttatttacggcgggacgcgcgattgaacaaggtcagagcggacaggcgagaaatacgctcaccaaagcggaagggctcattaaccggattgacgccattatccgttcgctgcggcagtttacccgtcgggcggagctggaaacgccattgtatcccgttgatctgcgccaaaccttcgtggcggcatgggagttattagccatgcgccaccaatcccggcagggagcgctttcactgccaaccgacaccgtatgggttagcggcgatgaagtgcgtattcagcaggttctggtgaatgtgctggcgaatgcgcttgacgcctgttcgcatgatgcggcgatcgcggtgacatggcagacgcagggagaggcgctggaggtttatattgcagataacggccctggctggcctggggcgctgttgccctctttactcaagccgtttaccaccagtaaagctgtcgggttgggtattgggctgtcgattagcgtgtcgctgatggcgcaaatgaagggcgacctgcgtctggcgtcgacgctgacgcgtaatgcttgcgtggtgctgcaattctcggtaacggatgtcgatgatgttgaatgatgaatgttctattttgctgattgatgatgacgttgatgtacttgacgcctatacccaaatgcttgagcaggcaggctaccgcgtgcgtggctttacccatcctttcgaggccaaagagtgggtaaaagcggattgggaggggatcgttttgagcgatgtgtgtatgccggggtgttccggtatcgatcttatgacgctgtttcatcaggatgacgatcaactgccaatcttattgattaccggacatggcgatgtaccgatggcggttgatgcggtgaaaaagggcgcctgggattttctgcaaaaacccgtcgatccgggcaaactgttgatattaattgaagacgcgctacgccagcgccggtcggttattgcacggcggcaatattgccagcagacgttacaggttgacctgattgggcgcagcgagtggatgaatcagtttcgacaacggttacaacaactggcggaaacggacattgccgtatggttttacggtgagcatgacacaggacgtatgactggcgcccgttatctccatcagctggggcgtaacgcgaaagggccgtttgttcgctatgaactcacgccggagaatgccgggcagttggagacattcatcgaccaggcgcaaggaggcacgctggtgttgagttatcccgaatatctgacacgcgaacagcagcaccatctggcgcgtttacaaagcctggagcatcggccttttcgtttggtgggcgttggcagcgcttcgctggtggagcaggcggcagctaaccagatagcggccgagctttactactgtttcgccatgacccaaatcgcctgccagtctctttctcagcgaccggatgatatcgagccgttatttcgccattatcttcgaaaagcctgcctgcgactcaatcatccagtgccggaaatagcgggggaattactgaaaggaataatgcgacgcgcctggccaagcaatgtgcgcgaactggccaatgcggcggagctttttgctgtcggcgtgctgccgctggcggaaacggtcaacccgcagttgcttctgcaggagccgaccccgcttgaccggcgcgttgaagagtatgagcgacaaattattaccgaagcattaaatattcatcagggacgaattaatgaagtggcggagtacttgcaaattccccgtaaaaaactttatctgcgcatgaaaaaatatggtctaagtaaagagcattataaattctgatattacagttactttcaatctggctgacaacaacagcaacgatgtcgttagccagataacgtcgcattaccgtaatggtaaatcattccattatgattatagattgcttattattcacctgagcatcaaattctatttcttaacttcaatataaggtaaaaatgcgtcaagttctctggcgtaataaatgtactcttgtccgacgatttgacaagatgaaaacttcatcacctctccagattacatctgaatatgaggacaagagaaatgaaaaaacatgctattgcagtaatgatgatcgccgtattttctgagtcggtttatgcggagtctaccttatttattccggacgtctctcctgagagcgtcacgacatccctttctgtgggggtgttaaacggtaaatccagggagctggtttatgataccgacaccggacggaagctgagtcaactggactggaaaataaaaaatgtcgccacgttgcagggggatttatcatgggaaccctattcgttcatgacgctggacgcccgcggctggacgtctttggcgtcgggatcgggtcatatggttgaccatgactggatgagcagtgagcagccaggctggaccgatcgttcaattcatccggacaccagcgccaactatgctaatgaatacgatttgaacgtgaaaggttggttattgcagggagataactacaaggcgggcgtaacagcgggctatcaggaaactcgttttagctggacggcaagaggcgggtcttatatttatgataatggtcgatatattggtaactttcctcatggcgtgcgcggtataggttatagccagcgtttcgaaatgccctatatcgggctggcgggtgattatcgtattaatgactttgagtgtaatgtactgtttaaatacagcgactgggtaaatgcgcatgataatgacgaacactacatgcgaaaacttaccttccgtgaaaaaacggaaaattcacgatattatggcgcgtctattgacgccggatattatattaccagtaatgcaaaaatctttgctgagttcgcttacagtaaatatgaagaaggtaagggcggtacgcaaatcatagataaaaccagcggtaatacggcgtattttggtggcgatgccgcaggtatagctaataataactatacggttaccgcggggttgcagtaccgcttctagaccacatcgggatgtcatcggtcataaccggccgatgacgactttttgctgaacgtgtggcatgcccggtgatattgtgtttacctcatatagatctggcgagtttggcgttaagacgtggcaaggaacagtagagggggacctcatccagatgttataaacttcaattcagaaagttactttccatatactctttgtgggactgcttcaacctttgggcagatatcggaaatgaaaaagatagaccaggcgactattcgctatcagaatatccggtacaccaactaccaacaaatcatttagtcgatggtctcgttgccattggttcatagagtgttggtcttggtatggatggctggggaagttatgtatcgaacattcttatgcaagattgcgcagggtctggtggtctatggtacacatatgggaagacattcacatatatttctgtaatcgatactaaaactttaacactaactaattgtttgtagaaagtggttgcattattaatggtttgagactcattgacataaaacaaacaccatctggtaatctgtcagaccccgcatcctcaacagttaactataaagattgtatggtagctgagatgtcattagtcctaatatcgtgtcagataaatttataaaagattactcatgttttgtgtcacatgcaaaaataattcggcttcgttaaggtctttaggggaaatacctaatggataattagttagattaacgttaacaacactttgaacgtgtaatgaatatgggggtataatataagtattgggagattgtaattaaaaattatgtaattatctgattattatatattcactccagcaaaggagaaaggcaattatggacgaaaagaaactcacagctcttgcggctgaactggctaaaggtcttaaaactgaagccgacctcagtcagtttttccatatgctgacgaaattaaccgtcgaaacggcgctcaatgctgagctggctgaccatctcgggcatgagaaaaatgctcctaaaacgagctcaaactcccacaatggctactcattaaaaacggtgctgtatgatggcggcgagatagtgctgaacatgctgcgtggccgtgaaaatacctttgaactgtagctgattaaggagcatcagacgcgtattacgagatggaaagtcagatttatccctttatgccaaaggcatgacatgactacccgcgaaatcatcgccaccttcaaagagatgtacgacgctgatgtgtcgcccatgctgatacttaagatcaccgccgcagtaaaagagttggtcaaaggggcgtcaaaaaatggagtatgccgatccaggactggtcgctggcaatgattcgctttattatcgagttcggtgaccgcctgagcgatcaccgttaatatagtggcagttacacagtatgactggcatgttccatattggatttatatgtaatagtaacagcctatctatttgattattttatttccaattttattaaaaaggaaatcagaaccaggctttgttaaatgtccccaatcaacggcagtgataaaatcaggaccattaccaactcttgtaagacatccactttcgttacataatgctttgtatgctgatatatattcaattcccatttttggaacattgttactaaagtaagagtcccactcgcttatttcactatttaatccatatgtcatatacaatggtggagtttttttaaactcactcaggtagttagatattattttaactaaatttgcattccattccgggactggtccaatgaaaacaatccttgagtcaggggatgcctctttaatttttttaatggttaatgataacgcatcaattgctaactttttatcatgtactccatttgttcctcgaactgaccatgtcagcagaaccacctcaggctgaacacgtttaatttcattaattctattattgtttagagtgatgacacttctctgtaaatcatctttaccgtcaacaaatagaggaggagcattaccatctgtcatttggcttattatataatcagaacctttattatctatataatgagaaagcccattgaaaagagccgccgcataagaatcaccaatgataaatatattatgcttgccattttttatacatccattggatatggcagcagtaagttgtactgagtgacatatccctccacggagtagttctccatatttataataattgtacacgtcagtaacagaagcatattcacttgctgatttattgatttccctgtctttaactccatttatatgaaaaataaatgcgccaattaaacccgtcccaaatacagataatgctaataatattgctgtgatatatttacttctggaatttctcagtggtttttcaattaaataataagttaatatcgccaaaaagaacgataataataaaagaagagttaattcatggtagtctggtgagccagcaaatattgaacgatagaatgaataaataggccaatgccacaaataaagaggatagctaataagaccaaagaaaacaacaggcctaacactaagcaatttcgacacaactaaatcattaccattagatgctattataagagaggcgccaagtattgggattattgctatatatccaggaaatgacatcttttcatctatcatggttattgataatgcgattagtataattcctaacagggacattaattttgataacgaagtgtttattcctataaatctcaatgtggatataatcgctccagccattaactcccaaaatcttgatgcgggagagtagtaattagctccgccatcagatgccattgtaaaaatgctaatcgcatagctaattataaatatagttgcgcatgataatactatgtttctgttatggtttttgcttctaaagcatagcaatataactactggccatattatataaaattgctcttcaattcccagcgaccacaaatgtagtaaaggtttaaggtatgattttgaatcaaaatagccagactcactccaaagagtaaagtttgatataaagaatgagccactaaaaacatgcttaccaagtaatttgtaatcatcctggaataaataaatccaaccaacaataagacatgatacaagaactatggataatgctggaaatattctaagcactctccttttatagaaatcaaggtatgaaaatgatttgtttgatgcagattttaatattattgatgttataaggtatccagatatcacaaagaatatatctactccaacaaacccacccggcaataatgatgggaaataatggaatattaccacagataaaaccgctattgcgcgtaatccatctatatcaggtctgtattttaagtgttccaacttaaattacctcaatttaaaaaaagattaataaaatggttgtgcatcttgcatcattcccgaagtttcgtgtaaacgaaaacggaatgacgagtggatcagatacggctattattttaattattgactccgtcacatctttacttccgtcattaataaaaataatctcaactttatatttttcaagttcattaaactcatgtaccgttctatagaaaatcggtatcgtgtcttcttcgttaaaaaccaggacgacaagagagattttcatttttatccctgaagataatgaatctggaatagataaagccgcataccaggctaattgccgagaaagtgatgagggtaaccaatggtggcaaagaacattggtcagccatccatccaacaacagcgctcagtgttcccatgaatcccatatacatcatgtagagaattgcagtagtgctggcattaaaggtgaagcgcgcattggcatagaagctgaacgatacagcgataacaaaatcggaaaagttcgtcagcgcctgatgcgtatgcatcccatacatacagaaagcaaatactccccaatgaatgagcgtgttaagaacaccgatcgatgtgtacttagcgaataacttcaacattatgaaaattagccgattcagaaaggtctggagtgtagcactacaaattggtttgatcgatataagcgatcaataattgtatttttaatagttttaagctattgagttttaatatattgatcgatgttatcgatcaattggtattgctgattgccaagcgtcttggaataaaaacgggacatgtaaagctttacatcgtcttacaaggctttgcatgttttttcagagagaggtacttgaaagggtggaagtgctggggagagggggagcgttaaaaattctgtataattttagtaacataaaataaaaaagaatggcacatgtcccatcccttcgatttcgacaaagcacttaaagcccttcaggtccggccaggcattaacgggcaaagatggcatcttaacgccattaatcaagtatttaaccgactctaccctgtctgctgaacttgattcccatctggctcaggatgttgaggcaaaccgtaaaaatggttccggcaaaaagccattaaagccccaacaggcagttttgaactggcaactccgcgcaatcgtaacggcacttttgagccataattggtgaagaagcttcagaccccctgtacgacgagatcgagcgcaatatcattcgactgtttgcgctggagatgagttatcaggacatcggccgggagagtgaagatctttatgccttcagcgtttcaaccgccaccgtcagtgcagtaccgataaagtcatccctgaactaaaacagtggcaacagagcccgctggagaaggtttatcccgtcgtctggctggacgctattcattataaaaaccgtgaggatggccgttatcagagcaaggcggtttataccgttctggcactgaatctagaaggcaaaaaagaagttctgggcctatatctgtcggaaagtgaaggtgctaacttttggttaagttctaacagcgagaggggactttaaagggatgcttttcgttatgtttataggcactattcgctggagatcataagacatcaaaaacgctgcaacgccttgtgtggtgtgggtttgctgagattcgtgagaggtgggtaaaagaggtcatggtgtcccctgcaggaatcgaacctgcaactagcccttaggaggggctcgttatatccatttaactaaggggacaacgcggcgccagtatagcgttttttattcgccggagtaagtgtagcgccgcctgactggttaaaccgtcgccactcagcgctgtttttccgcttttttccgctcccgttccaggcgctcgccgcgtagcctcgcttcttccttacgcttattgctcatatcgttgcggatctgcgcgtggctcatcaatgcgaaaataaaggtgccgccgcagatatttccggcaagtgtgggaagggcgaagggccagaaaaagtcgctccagggcagcgtgccgttgaaaaccaaatacaaaatttcaacggaaccgacgacaatatgggtggtatcgcccagcgcgataagccaggtcatcaaaataatgaccacaatttttgccccgcctgcagcaggaaacatccataccattgtggcgatgatccagccagagataatcgcgttggcaaacatctccgttgggctatttttcatgacctccataccaattttgacaaaggcatcgcgggtctcttcatcaaatataggcatatattcaaaagcccacgccgcaaccccggtgccaataaggttgcccaataagactacgccccataagcgcatcagcaggccaacgttactcagcgtgggattttgcattaccggcaatacggcggtaacggtattttcagtaaataattgctggcgggccatgatgacaatgataaaaccaaaggtataaccgagattttccagtaaaaagccgccgggaacgccttcaagctgcacgtggaaaatccctttcgccaggagtgatgcccccatagaaagtcctgcggcaatggctgaccagagcaaagccatcgcatcgcgttccatctctttttcaccatcctggcgaatatgttcatgaatcgccatggcgcgggaaggaagacgatcttcatctacttcaatctctttaccgctttgtttttcttcgctttcaacttccaggtcactgctgtgccggttaattttatcgtcgttaaggctatccatgatgatccttgctgattaacacatattaataaagcgtagcggtttttcatttacccaggccggggcattctccgaaaaaataaaaataatcacgctcgtttttatctgtttcgttagaatagggccgtcatgttgttgcgttaccaggctatgctcagagcaatgagatcgcgcatatagacatcgtttgacgtgctgttaaaatcgctcacacctaaacaggcggatacggtagcgttccgtcatggatggcaatcagcgatagccataattcacagggagacatctatgaagcttcgcctgtcggcgctggcgctgggaaccacactgctggtcgggtgtgcgagttccggtacagaacagcaggggcgttcagacccatttgaagggtttaaccgcaccatgtacaacttcaactttaatgtgctggacccgtatgttgttcggccggtcgcggtcgcctggcgtgattatgttccacagcctgcgcgtaacggtttaagtaatttcaccggcaacctcgaagaaccggcgatcatggtgaactatttcctgcagggcgatccttatcagggtatggtgcatttcacccgtttcttcctgaataccttattagggatgggcggctttattgacgtcgcgggaatggcgaatcctaagctgcagcgcgttgaaccgcatcgctttggcagtacactgggccattatggcgtggggtatgggccttatatgcaacttccgttctacggcagcttcacgctgcgtgaagatggcggggatatggcggataccttgtatccggtgctctcgtggttgacctggccaatgtccataggaaaatggactatcgaagggatagaaacccgcgcgcagttgctggactccgatggtttgctgcgccagtcttccgatccttatattatggtgcgcgaggcatacttccagcgtcatgactttatcgccaatggcggaaaactcaagccgcaggaaaacccgaacgcgcaagcgattcaggacgaactcaaagagatcgactcggaataaacggcagtaaataaaaaggtgagcgcaatgctcacctttttgatccgtttcagaaagagattagaacgcgtagttaaagttagtaccgaacagccaggctttcccttcagattcaaactgataagggccttcattaattttcacgctctgaccatgcatataagagacgccaacgtcgacagacgcatctttgttaaaggcgtaagtcgtaccggcgctcagccagaaacggtcctgatccggaatagagatagaacggttttgcgctggtaccgggctgtcatcgaaggcgataccggtacggaacgtccagttgtcatcgtagtaataggtggtacccaacgcaatgcgataagcgtctttaaagccttcatgcttctcaaagagcgtatcgccggcggtcgattttgccttcaattcctggaactgactccagctggtataggccaggctatagtggatggcccactgtggcgccacacggttataaccggacacttcccacatttccggcagattcagcgtcaggtagcctgactgcgtcgcgccgccggttgccgttgggataggcaggttaaatcggtttatagcgatgggaagatcgctactgtagttgcctttaaagtcaattttgacttccgagcggtaggtcagcgcgtagcggttatttttatccagttcataaaggataccggcattccagccaaagccccactgattaccgttcaggtgggcaatcttggtgtcgctgagaatctgacccgcgaccggcgccagcgccggattctgtgccgcgaccaactggcctaaatcgcccgcaaaacgttcgattttcgcgcgcgcgtataccgcatcaaagccgaggccgaagctccaggcctcatttaagcgataagcgccgcttaaattcaggttcatggtttcaagatcggtcgtaccgccaaccgagccgccggcgtatgtgtcgttaaactctgtcgccagaccatagttagaggtaatagaagccccccagccaaactggtcgttaatcggggcgacaaaatggacgttcggcacccaggccgttggcgcgatgttatccgcatctaacgtccgacgagatggcgatgtcccgctaatattaacatcaggatcaatataaactgcgcccgctgaaaacgtcgggcggtcaaacatggtaattaacgccgggttgcggctaacgttacccgcatcatctgcgattgcgccttcacccgaataggcccggccaaggccagaggaagaaaattcgtttaactgaaagcccgcagaccaggcctgggtggagatgattgccactgcgactgcgagagcagactttgtaaacagggttttctggctcatgaccataacctcattgattatttttatacaaactatgttacatgctgtaacaggagcgcgaagtgtagggtctgcggtacgacttagaaatcagaccagtggcgagagtataggtctgaccagctagaatgttgcaagtatgtttataagttttttcaattgtgatcttagaaacgagatctggctggtaaaatcggcgggcttaacggtcacccgatcgcgtgatttttgttttagatcatttttaagtgtgatttcggtcacttaacgcgtttcccaccattaacgactggagaggcgaatgccgggagcgtaaaatatccccatcgtttatctggcaccctgggtgcaaatacagaggaaatctacaatgagtaaatgcagtgctgatgaaaccccggtttgctgctgtatggacgttggaaccatcatggacaactccgattgcaccgcgtcatacagccgcgtattcgctacccgcgcagaggctgaagagacgctggcggcgttaaccgaaaaagcgcgtagcgtggagtctgaaccttgccaaattacgccaacctttaccgaggaatccgaaggcgttcgtctggatattgattttgttttcgcctgcgaagcagaaacgctgatcttccagctcggcctgcgttaatccgttcattcacgacgcctccgtcatcatctggcggaggcgttttctttttttgtcgtttcccttcactgtgccttagctcccactttcttttctctctgcttggctaaatgtaaaaaattggttaagactgtgatcaggtcagaccactaatttatttttttacaggggagtactatgcgtcaggctttaccgttggtcacccgtcagggcgatcgcattgctattgtcagtgggttacgaacccccttcgctcgtcaggccactgcatttcatggtattcccgctgttgatctcggcaagatggtggtaggcgagctgctggcgcgcagtgaaattccagccgatgccattgagcaactggtttttggtcaggtagtacaaatgccggaagcccccaatattgcgcgcgaaattgtgctgggtacgggaatgaatgttcataccgatgcctatagcgtaagccgcgcctgcgccaccagttttcaggcggtagcgaatgtggcggaaagcctgatggccggcacgatacgcgcgggtatcgctggcggcgcagattcgtcgtcggtactgccaataggcgtgagtaaagccctggcgcgggtactggttgatgtcaataaagcccggacgacccgccaacggctgacgcttttttctcgtctgcgcttacgcgacctgctgcccgttcctcccgccgttgctgagtattccaccggtctgcgcatgggcgataccgccgaacagatggcgaaaacgtatggtattacgcgtgaacagcaggacgcgctggcgcatcgttcacatcagcgcgccgcgcaggcatgggcggagggtaaactggcggaagaagtgatgacgacctatgtgccgccgtataaaaacccctttgcagaagacaacaacattcgcggtgcctccacgctggcggactacgctaaactgcgtcccgcttttgaccgaaaacatggctccgtaaccgccgccaacagtacaccgctgaccgacggcgctgccgccgttattctgatgaccgaatcccgcgctaaagagctggggctgcgcccgcttggttatctgcgcagctacgcctttaccgctattgatgtctggcaggacatgctattggggccggcctggtcaacgccgctggcgctggagcgggccgggttgacgatggccgatctgacgctttttgacatgcatgaagcgtttgccgctcagactctggcgaacttacaactgctgggcagcgaacgatttgcccgtgaggtgtttggtcgtgcgcaggcgacaggggaggtggatgacgctaaattcaacgtgctcggcggctcaatcgcctacgggcatccttttgccgcaacgggcgcgcggatgataacccaaacgttgcatgaattacggcgtcggggcggaggttttggcctggtcacggcctgcgcggctggcggtcttggcgcggcgatggttctggaggcggaataatgactaccacatcagcttttatgcttagcgtgcgtctggataatgtcgcggttgtcgctattgatgtccctggagaaaaggtgaacaccctgaaagcggagtttgccgcgcaggtacgcgccatcctgaagcagatccgggaaaataaagcgttgcagggcgttgtttttatctcagccaaagcagataactttattgctggcgctgatatcaacatgataggccactgccaaaacgcgcaggaagcggaaacgctggcgcgtcaggggcaacaactgatggcggagatccaggcgttgcctgttccggttatcgccgccattcacggcgcctgtctggggggcggtcttgaaatggcgctggcctgccatcggcgtatctgtaccgatgacgttaaaaccgttctcggactgccggaggtacagttagggcttttaccgggatcgggcggaacgcagcgtcttccgcggctggtgggggtcagtaccgcgctggatatgatcctgacaggtaaacagcttcgcgccagacaggcgcttaaagccgggctggttgatgatgtggtgccgcaaactattttactggaagcggctgtcgagctggctaaaaaagaacgcctggcgcagcggactttaccggtccgtgaacgtatcctggcggggccgctggggcgcgcgctgttatttcgcctggtgcgtaaaaagacggcgcaaaaaacgcagggtaattatccggcgacggagcggatcattgatgtgattgaaaccggactggcgcagggcagcagtagcggctatgacgcggaagcgcgcgctttcggcgagctggcgatgacgccgcaatcgcaggcgctgcgcgctgttttttttgccagtaccgaggtgaaaaaagatcccggtagcgatgcaccgcccggcccgctgaacagcgtgggcatcttaggcggcgggttaatgggcggcggtatcgcctgggttacggcctgtaaaggcggtttgccagtacgaattaaggatataaatactcaggggatcaatcatgctctgaaatacagctgggatctgcttgaaacaaaagtacgccgccgccatatcaaagccagcgaacgcgataaacagttggcgttgatatcaggttcgaccgattaccgtggtttcagtcatcgtgatctggtcattgaagcggtgtttgaagatctgccgttaaaacaacagatggtggcggaagtggagcaaaattgcgctactcacaccatttttgcctccaatacttcttccctgccgattggcgatattgcggcgaatgcggccagaccggaacaggtgattggattgcacttttttagcccggtcgaaaaaatgccgctggttgaggtcattcctcacgcgtctacttccgcgcagaccatcgccacgaccgttaagctggcgaaaaaacagggtaaaaccccgatagtcgtcagtgataaagccgggttttatgttaaccgaattcttgcgccatatatcaatgaggcgattcggatgctgactgaaggcgaacgcgtcgaacatattgacgccgccctggtaaaatttggttttccggtggggccaatccaacttttggatgaggtaggaatcgacacgggcactaaaattattcctgtgcttgaggcggcgtatggagaacgttttagcgcgcctgcaaatgttgtcgcttcaattttgaatgacgatcgcaaaggtagaaaaaatggtcgcggtttctatctttatggcgaaaaagggcgtaaaagcaaaaaacaggttgaccctgctatttataagcttattggcgtgcaagggcagagtcgactgtctgcgcagcaggtggcagagcgctgtgtcatgttaatgcttaacgaagcggcgcgctgtttcgacgaaaaagtgattcgcagcgcgcgcgatggcgatatcggcgccgtgtttggtatcggttttccgccgtttctcggtggcccgttccgctatatggatgctctcgggccgggtgaaatggtggcgacattacagcgcctggccgcactttacggtcctcgttacgcgccttgtgaacaattagtgcgcatggcggagcgcagggagcatttctggacgaatggggaaactgaccagggaaattgaggtcaaagagaatatgaatccgcactgaatgcctccttagtggcgaaataataatcaaggattgactatacttacgccattgaggtaaaaaacagcgtttcattcggtgaatggataaggcacaatgccggccaccgcatttttgccgcagccaataggggcatgtggtaagcgtgttggtgaaactggttaacaaaagcggtgcaatatgcaagtttttatcatgcgtcacggcgacgcagccctcgatgccgccagtgattcggttcgtcccttgacctcttgtgggtgtgacgagtctcgcctgatggcgaactggctgaaaggtcaaaaagtggatatcgaacgtgttctggtgagtccgtttcttcgggccgaacagacgttagatgtggtcggcgattgtatgaatctgccgactcaggtggatgtcctgccggagctaacgccctgtggcgatgtcggtctggtcagcgcctaccttcaggcgctggccaatgaagagatcggatcggtgctggtgatctctcacttacctctggtcggatacctggtatctgagctttgtccgggcgaaacgccgccgatgttcacgacgtccgcaattgccaacgttacgcttgatgaaagcggcaaggggacattcaactggcaaatgagtccctgcaatctgaaaatggcgaaagcgatttaatctttgctgcctgataaggcgcttgcgccgccatccggcaattccgcatcagggtaattcgggcggttgccactcttccacttcaatcaacaccagcagcgcggcgtcgccgccgtactctttcggcgcctgatgaaaggccatcacatgcggatgctgcgccagccataacggcgtttgctgtttcagaatatgtttaccgtgtccatgcatgacgcaggcgcaaaaaatatgttcccgacggcaggcggcaatcagcgcccccagttcctgcttggcctgaagctgcgttaagccgtgtaaatccagaaacagttctggcgaatagtcgccgcggcgcattttttttagctcgaaatggctgacatcttcacggacatactttaccggcccttccgtattgagcagcggctggaactcatcagaaaaatagtggctggcgtccgcctgttcctgaattaaccttcgggtagggacttccgtgattttcttgcgcagtggccgatggacgatagtatcctgtttaatctttcgggtgccgaccatcagctgacggaacagcgcctggtcctcctcgctgagcgatgttttctttttcattcgtgggtctcgtctgatcttttgccttagtttacccgacccggaggatatccgaacggtcaaaacggatttttcgtattctcccgccgcgtcaatgctgatttatccctgtcttcgtggcaaactagccgccgaatttaatgcgagcatgccctggaggaatacgtggataaaattttcgtcgatgaagcagtaagtgaactgcataccattcaggacatgttgcgctgggcggtaagccgctttagcgcggcgaatatctggtatggacacggtaccgataacccgtgggatgaagcggtacaactggtgttgccgtctctttatctgccgctggatattccggaggatatgcggaccgcgcggctgacgtccagcgaaaaacaccgcattgtcgagcgagtgattcgtcgcattaacgagcgtatcccggtagcctacctgaccaataaagcctggttctgcggccacgaattttatgttgatgagcgcgtgctggtgccgcgttcaccgattggcgagctgattaataaccacttcgctggccttattagccaacagccgaaatatattctggatatgtgtaccggcagcggctgcatcgccatcgcctgtgcttatgctttcccggacgcagaggttgatgcggtcgatatttcgccggatgcgctggctgtcgccgagcataacattgaagaacacggtcttatccatcacgtgacgccaatccgttccgatctgttccgcgatctgccgaaagttcagtacgatctgattgtcactaacccgccttatgtcgatgcggaggatatgtccgatctgccgaacgaatatcgccacgaacctgagctggggctggcgtccggcactgacggcctcaaattgacccgccgtatcctgggaaatgcgccggattatctgtccgatgatggcgttctgatttgtgaagtcggaaacagcatggtacatctgatggagcagtatccggatgtgccgttcacctggctggagtttgacaacggcggcgatggcgtctttatgttgaccaaagcgcagttgctcgcggcccgtgaacatttcaatatttataaagattaaaacacgcaaacgacaacaacgataacggagccgtgatggcaggaaacacaattggacaactctttcgcgtaaccactttcggcgaatcacacgggctggcgcttgggggtatcgtcgatggcgtgccgcccggcatcccgttgacggaggccgatctgcagcacgatctcgacagacgccgccctggcacctcgcgctatactactcagcgccgcgaaccggaccaggtaaaaattctctccggcgtgtttgatggcgtgacgaccggcaccagtattggcctgctgattgaaaacaccgatcagcgctcgcaggactacagcgcgattaaagatgtttttcgcccgggacacgcggattacacctatgagcagaaatacggcctgcgcgattaccgcggcggtggacgttcttccgcgcgtgaaaccgcgatgcgcgtagcggcaggggcgatcgccaagaaatacttggcggaaaagttcggcatcgaaatccgcggctgcctgacccagatgggcgacattccgctggagattaaagactggcgtcaggttgagcttaatccgttcttttgccccgatgcggacaaacttgacgcgctggacgaactgatgcgcgcgctgaaaaaagagggtgactccatcggcgcgaaagtgacggtgatggcgagcggcgtgccggcagggcttggcgaaccggtatttgaccgactggatgcggacatcgcccatgcgctgatgagcatcaatgcggtgaaaggcgtggagatcggcgaaggatttaacgtggtggcgctgcgcggcagccagaatcgcgatgaaatcacggcgcagggttttcagagcaaccacgctggcggcatcctcggtggcatcagtagtgggcaacacattgtggcgcatatggcgctgaaacctacctccagcattaccgtgccgggacgtacgatcaaccggatgggtgaagaggtcgagatgatcaccaaagggcgccacgatccgtgtgtggggattcgcgcagtgccgatcgcagaagccatgctggcgatcgtactgatggatcacctgctgcgccatcgggcacagaatgcggatgtaaagacagagattccacgctggtaagaaatgaaaaaaaccgcgattgcgctgctggcatggtttgtcagtagcgccagcctggcggcgacgccgtggcagaaaataacccatcctgtccccggcgccgcccagtctatcggtagctttgccaacggatgcatcattggcgccgacacgttgccggtacagtccgataattatcaggtgatgcgcaccgatcagcgccgttatttcggccacccggatctggtcatgtttatccagcggttgagtcatcaggcgcagcaacgggggctcggaaccgtcctgataggcgacatggggatgcctgccggaggccgctttaatggcggacacgccagtcatcagaccgggcttgatgtggatattttcttgcagttgccgaaaacgcgctggagccaggcgcagctattgcgcccgcaggcgttagatctggtgtcccgcgacggtaaacatgtcgtgccgtcgcgctggtcgtcggatatcgccagtctgatcaaactggcggcacaagacaatgacgtcacccgtattttcgtcaatccggctattaaacaacagctttgcctcgatgccggaagcgatcgtgactggctacgtaaagtacgcccctggttccagcatcgcgcgcatatgcacgtgcgtttacgctgccctgccgacagcctggagtgcgaagatcaacctttacccccgccgggcgatggatgcggcgctgaactgcaaagctggttcgaaccgccaaaacctggcaccacaaagcctgagaagaagacaccgccgccgttgccgccttcctgccaggcgctactggatgagcatgtactctgatggacaatttttatgatctgtttatggtctccccgctgctgctggtggtgctgttttttgtcgccgtactggcaggatttatcgattctatcgccggaggcggagggctgctcactatccctgcgctgatggccgccgggatgtcgccggcaaacgcgttggcgaccaataaattacaggcgtgcggcggctccctctcgtcttcgctctattttattcgccgtaaagtggtaaacctggccgagcaaaagctcaatattctgatgacgttcattggctcgatgagcggcgcgctgctggtgcagcacgtgcaggcggatattttgcgccagatcttgcccatcctggtgattttcatcggcctctattttttattgatgccgaagctgggcgaggaagatcgccagcgccgcctgtatggattaccgttcgcgctgatagccgggggatgcgtcgggttttacgacggctttttcgggcctgccgcagggtcgttttacgctctggcgtttgtcaccttatgtggctataacctggcgaaatccacggcacatgccaaagtgcttaacgctacctccaacgttggcggcctgctgttatttatcatcggcggcaaagtgatctgggcgacgggctttgtgatgctggttggtcagtttttaggggcgcgaatggggtcgcgtctggtgttgagcaaaggccaaaagcttatcagaccgatgatcgttattgtctcggcggtgatgagcgccaggttactttatgatagccacggacaggagatcctccactggttggggatgaattaatgaacagtacgcaccattacgaacaattaattgagatttttaacggctgctttgccgaagaatttaatacccgtctgattaaaggcgacgacgaaccgatctatcttcctgctgacgcgcaggtaccgtaccaccgtatcgtctttgcgcatgggttttacgccagcgcgctgcatgagatttctcactggtgtatcgccggtaaggcgcgccgcgaactggtcgactttggttactggtactgcccggacggacgcgacgcgcagacccaaagtcaatttgaagacgttgaggtgaagccacaggctttcgactggttgttttgcgtggcggcggggtatccctttaaacgttagttgcgacaatctggaaggcgatattgagccggatcgcgtggcgtttcagcgccgggttcatgcgcaggtaatggcgtatctggagcagggcattcctgaacgtccggcccgcttcatcaaagcgctacagaattactatcacacgcccgaacttaaggcggaacagttcccgtggccggaagcgcttaattaaagccagcgccacgtttacaatgaggaaagaagatgatcgcggagtttgaatcacgcattctggcattaattgacgatatggtagagcacgccagcgacgatgagctttttgccagtggatacctgcgtggccacctgacgttagccattgccgagctggagagcggtgatgaccactccgttgaggcggtctatgccaacgttagccaaagtctggagaaagcgatcggcgccggcgaactgtcgccgcgcgatcaggcgttagtcaaagcgatgtgggacaatttgttcgacaaggcaaaacaataacgccgtggaccggaaggcgacgcttgccgccttccgctattgactggcccattacttcaccgcttttcccttcaataactttctcacccataaccgatttggatttaacgccgccagcgtaccggcatccagtggaatcggctcgttactcatctgcgccgccagaatttctgcgcataatggcgctgaacacaaaccacgcgatcccagcgcgccgagcataaataaacccggatacacaggcgcagacgccgccgacgttttattatcggctaaatcggcgtaatgcgtcagcgtggcgtggtaatccgggacattgcccaccatcggcagatggtcgcgggtggcgcaacgcacgccgcaacgggcgctgttgccgctaacgtcaacctctgtggcccagttcgcatccggaaaacagtcaagcagacgctgtcggttctgacgctgatcttcttcgcgccagacggtgctttcgtcgccccggtgatagctggcgccaatacagtgctgctgattatgcggattttgcggcgtcagatagccgtcgtagcataacacctgacgcaacgccgagagggcgggggtggtgggaatatgactgacctgccccccgacggcataaaccggcagcggccgggtctgatcaaaacggttaatctgatggccgttcgccaggacgacagtctcatggctggcggtttcacctgacgtaaagcgcagttgccagcgcgactcctgcgcaacgagcgacgtgagcgtatggcgaaagcgcgtttgtaaaccctgttcagtcgccagtgcgatgactgcgcgagttaattgttccgggcacagccagccgcctgccggataggtaattcctccgcagcgtgtcgtcacgccaaccgcctgttccgcctcttcggcattgagcgccgaggccagtccggcgggcagcgccagggacagcatctgggcaattttctgctggcttttctcatcccatccgagctgtgtcacgccgcaccaggcatgatcaaaagagacgggcagggcatcatacaggcgacgggcaaaggtgaatgcggtcgggaaaaagcgattaatggcggcgtcatgtttgctaaggagcggataaagcgcgccctgtcgattaccggaagcgccctgggcgggctgatcatctgcgcaatagagcgtcacctgccagccgcgacgcagtaacgccagtgataacagcgcgctggcgatgccgccgccaatgatcgccgtttcacgtttttcgcttccgctgcagtaaaaccagggcgcggaaagggtcggcatgaggtgttgttccatcactccacaaagcatctcgcgtttacgtccgaagcctttgtgtttttgcatggtaaaaccggcttcctgtaatccccgacggacgaaacccgccgaggtaaacgtcgccagcgttgcgccgggccgcgccagccgcgccatcgcgttaaacaggtttggcgtccacatatccggatttttcgccggggcaaaaccgtcgaggaaccaggcgtcgactgtttgattcagcgtggcgtccagttggtcggtcagctcattaatatcgccaaaccacaaatccagcgtcacccgaccccgatccagcaataggcggtggcaccccgggagcggcagcggccattgcgcctgcagctgctctgcccagggcgcgagctccggccagtgttggtgcgccagcgccagatcgtcgcgcgttaacgggaatttctcaaagctgatgaaatgtaacctttgcagcgtcgcctgtgggtgcgcagaacgaaagctgtcaaacgcctgccacagcgtcaggaagttgagtccggtgccaaaaccgctttccgcgactataaataatggatgtgaatgtacgggaaatcgctccgcaagacgattgccgccaagaaaaacgtagcgtgtctcttcgagtccattgtcattagaaaaatagacatcatcaaaatctcgggaaacaggtgtaccctcagcgttaaattcgagtgtggcgggttgtatggcgtattgtttcacgtaagttactcgtctgacgggcggtatcgcgatcttaacgatgtgtgcctgatggcgcaaatttccgtactaaatggctgatcggacttgttcggcgtacaagtgtacgctattgtgccaatcgaaacttaaaaatagtgcgaattacagaggtattgaatgaaacgtgcagtgattactggcctgggcatcgtttccagcatcggtaataaccagcaggaagtcctggcatctctgcgtgaaggacgttcagggatcactttctctcaggagctgaaggacgccggcatgcgtagccaggtatggggcaacgtaaaactggataccactggcctcattgaccgcaaagtcgtgcgctttatgagcgacgcctccatctatgcttatctgtctatggagcaggcagtggccgacgccggtctggcgccggaagtctatcagaataacccgcgtgtcggcctgattgcaggttccggcggcggctccccgaaattccaggtctttggcgcagacgccatgcgtagcccgcgtggtctgaaagctgtgggcccgtatgtggtgacgaaagcaatggcatccggcgtttccgcctgcctcgctacgccgtttaaaatttatggcgtgaactactccattagctccgcttgcgcgacctccgcacactgtatcggcaatgcggttgaacagatccaactgggcaaacaggacatcgtttttgctggcggcggcgaagagctgtgctgggaaatggcctgtgagttcgatgcgatgggggcactgtccaccaaatataacgatacgcctgaaaaagcgtcccgtacctatgatgcgcaccgtgatgggtttgtcatcgcgggcggtggcggtatggttgttgtcgaagagctggagcacgctctggcgcgcggcgcgcatatctatgcggaaatcgtcggctatggcgcaacatccgatggcgcagacatggttgctccgtctggcgaaggcgcagtacgttgcatgcagatggcgatgcacggcgtagacacgccgatcgactacctgaactctcacggtacgtccacgccggtaggcgacgtgaaagaactcggtgcaatccgtgaagtgtttggcgataacagcccggcaatttctgcaaccaaagcgatgaccggccactcgctgggcgcggctggcgtgcaggaagccatctactctctgctaatgctggagcacggttttatcgcgccgagtatcaacatcgaagagctggatgagcaggctgcgggcctgaacatcgtgaccgaaacgaccgagcgtgaactgactaccgtaatgtctaacagcttcggttttggcggcaccaacgccacgctggtgatgcgtaagttgtaagcctgactattacgttgtagtatcaacaatgaaacaggtcgctaatgcgacctgttttttcattcagggaacaacaaattatatggatattatataaatgccaactaatacattagataaaattaggcatagtttgagttgtgtggctgttttatttggtttgttcggcatttttgtttttgcctcattttcgccttcctatgcctggctttatttgggaggtctggctgcgccttttatatatagtattgtttttgtctacgcgattgccgcctggagtatttattcaaagtattatccgtttttatcattgggccgcttatcatttgtggaatgttttgttccggcgctggccctggtgtgccttaccgttctctacaatgtttttagtggcccggaaccctggatggccgagttatcaaggcaattttttcttcataaatttcttaacacgctggtgatgtgctttctggctcctgtggcggaggaaattatattcagagggtttttattaaacagcagtatcggttggggtcgatactcaagagtttccggtattattattacttcactcgcttttgcatttatgcatacacaatatctctttgcggtgacttttgtttatctgtttgttttttcatcgatattatgcgttgttcgaatgagaagccgtggactaatgataccgataacacttcatattttaaataatgcctgggttattttcggcttgctgttttcagcgacggaataagagcctgatgaaataggctctttaacctctccggtacgaacaagagaacgatggcggttcccttttttaatgcttctcatattccggcgcgacttttgctgaccaggcctcagcctgggtgatggcgcctgcgtcataaatcggctgttcataatccttatcagcatcccgaacgcggtaaattttccagcgtccctcttcccaacgggtataaacttccaggtggatgggcgttgactctgtagccaacagaacatccactttttctccgccgaggaaagggtgtgccttcccaacccgtaactgtggaatccactctggcgcatagtcctgcgcatacataaaataatctgcccctacaatctcctgttcataaagggactgtattagcgccaggcgatgaataacctctttagcaacgtaacgttgcattaaggcggtggtgtcgtcaggggtattcacatcgttcatgaacgtcgtcatccatgaggtatagaactgcttcacggcctgcgtactgtcgtgatgaggcgcagagcaactacaaagcaacaggataagcgcgacaagggagaacgttttcattaattcttcctgtagatggtatatgagggcctggctgcccggtagcccgggccggcccacatatcgcgttgtttaaaatctgaataccactctgcgccatcgtatatcgccatgtgaccgctcgggtttccgccagcgtaaggttgaataatgatgacgtcaccctcgcgcggcatttcataggtaccaatagcggtgaatccggcgcttcttaacattgggccataatctttcgcatgatatgtatgccccagcgtgataccgcccgcctgaattgcctttcgggtaaattccgcacaccggccttgagaatgagaacctgcatgcgttttggcataattaaccgccactcttttatcccaactcataatgattcctgttaataaaatacgtaatagcaattacgtaatgctttaacagtatttgattcgggaagcatgacagatcgtgctattactattttcaatataataagtttaaatatttattaattgttgagattgataagttaaagccaatttattcagcattaactattattctgcgatatcggcatcattttttatttgcatatcgccatagcgcgacggccagatctcctgcggcgtgatgcccagcgcgtccgcaataatccgttcggctctcggccaggaacgggtaaagacattgcgcagtgaatcaggtgataaaccggcctgacgagaaagatctctgagcgtaatacctcttttttccagtgcacttttaatatctgcacgatgccagtcttggctttttggttccattctgtaatcctaagaagatgtgttatcggcgccgatatttttaagataaaattagcgcatggaaaaggaagttactttctttttcacgctaagaatagtgccagaaagaaagcaaaatttcgcgaaaaagaagaaatatttttatttcatcaggggaaaggaaagaaaccgatggcaaaggaatggttcacggttaaggaatgtcttggcttaccggggtttccgggaagcgagcctgcggttcgcgaacgtttatataagtacagtgaagggaaagcgggggtcaggcgtaagcgtgttaaatcaaaggccgaggagtttcatatatctgttttccctctctatgttcatcgttatctggacgacagcggagaggaaccgacgccagaacccatttccttacaggaagcggagcctgaagatatctgggagatgatgttcaggttactgacgccagaacagcgcaagcaggtgactggacggtttaaggtgagagggatgaaagcggtctttctctttctgtttgatgacacgccgccgcgttgataccctggctgcaatttcaaggttgacaaatttcgcgtctcacaggcagacttcactttctacattatccttccgataatgcgtaagcgtttaacgttatccaacgcaccttaatcctgacgttcaggtagaggggggcgtggcctttccccgccttactctgcattctggagtaatgcatgacagcagttagccaaaaaacaacgaccccgtctgcggatttttcgctgttccgcatcgcctttgcggttttcctgacctatatgacgatcggcctgccgttaccggtcattccgctttttgtccatcacgaactgggctatagcaatacgatggttgggatcgccgtgggcattcagttttttgcgacggtactgacgcgcggctatgccggacggctggcggatcaatatggcgctaaacgatcggcgttacaggggatgcttgcctgcgggctggcgggcgccgcctggctcctggccgcgctgttgccggtttccgcgccggtaaaattcgcgctgcttattgttgggcgtttgatcctcggatttggcgaaagccagctgctgaccggaaccctgacctggggactggggctggttggcccaacgcgttccggtaaggtgatgtcgtggaacgggatggcgatttacggcgcgctggcggccggtgcgccgttgggcttgctgatccatagccactttggcttcgcggcgctggcggggacgacgatggttttaccgctgctggcctgggcattcaacggcaccgtgcgtaaagtgcctgcgtatacgggggagcgaccttcactgtggagcgtggtcgggcttatctggaaaccgagcctgggcctggcattgcagggcgtgggctttgccgtcatcggtacgtttatttcactttattttgtcagcaatggctggacgatggcgggattcaccctgaccgcgtttggcggtgcgtttgtactgatgcgcatattgttcggttggatgccggatcgctttggcggcgtgaaggtcgccgttgtctcattgctggttgagacggcagggttgctgctcttgtggctggcgccgacggcctggatagcgctggtaggcgcggcgctcaccggggcagggtgttcactgattttctcggcgctgggcgtggaggttgtgaaacgcgtacctgcacaggtacgcggtacggcgctcggcggctacgccgcgtttcaggatatctcctacggcgttaccggcccgctggcgggcatgctggccacgtcatacggctatccttccgtattcctcgcgggagcgatctccgcggtggttggcatcctggtgacgatattatcgttccggcgcggttaagaaaccagccagaaaagcgccagtacaattattagcgcgataaacaacaggcctggtcgcgcagacagatttttcacggtttcaatcatcggcgcaaacgggcggtagatgggttgaatagagagcggttcgagctcatccgcctcccgctctacgcgacgcaggaaaatatggttaagtaaatcctgcacctgcgcggtggtcagcaccgtttgcggctgaatttgataagtgtgttgggcatactctttgatcgctgtgagttcgtccggttccagcggttgttttaacgcagcttgcagcgtatgtagcgtaggcgcgtgttgtagtgacagcgtctgccgcgcctgtagccatgtcgccagatgggtaaactgttttgccgaaatgagctcgccgcttttcacgccggagagttccagcattgattgccagataagtttgtttgactcgccggtcgcggccgccagcttcgtcaccaactgattcaacgtattatgttcagcaggcaataatggccgatccgttgccggacgttgttgcggctgcggaatggaaagctgcccctgttgcaggagcgtcagcacgtttttgagttgatcgggcgtaagctggctaagcgcggtttgaccgtattgttgacggataaaatcgctgacggcctgacgattattcccgacgccaagcagctctgttagctgtgaaagcacctgacgattggcgtgattttgctgcgctacgcccagacgctgggtaagattctgttcagcggcggggaagtggcgcgacagtagcggcgcgtcattttttatccccagatcgtgtttcattccggcccatacttccgcgctttgctgctgggtcagtgaaatcaggcgcgtgatcagcctttccagtaccgtacgctgttgcatggaaagcggctgctcgctcgcagcggaaagaggattacgcccttcgcctggaggctgtgcaggggcgccggagatgggatgcataattaattatcctttaaccataaatctgagcaatatatgcttggcggccagattatggcacacttgtccggttaactctcgttctcaaacaggtacgacagtcgtgaaaattctcgttgatgaaaatatgccttacgcccgcgaattatttagccgcctgggtgaggtaaaggcagtgccgggtcgcccgatccccgttgaagaattgaaccatgccgatgcgttaatggtgcgttcggtcacgaaagtgaatgaatcgctgctgagcggcacgccgattaacttcgttggtactgctacggcaggcaccgatcatgtggatgaggcatggctgaagcaggcgggcatcggtttttcagccgcgcccggctgtaatgctatcgccgtggtggagtatgtgttttccgcgctgttgatgctggccgaacgtgacggcttttcgttacgcgatcgcactatagggattgtcggcgtgggtaacgtcggaagccggctacagaccaggcttgaagcgttgggtatccgcacgttgctgtgcgatccgccacgcgccgcacgcggggacgagggtgattttcgtacgctggatgagctggtgcaggaagcggatgtcctgactttccatacgccgctctataaagacggaccgtacaaaacgctgcatctggccgatgagacgctgatccgtcgactgaaacccggcgccattctcattaacgcctgccgcggcccggtggtggataacgccgcattgctggcgcgactcaatgccgggcagccgctgagcgtggtgcttgatgtgtgggagggcgaaccggatcttaacgtcgcgctactggaagccgtggatatcggcacgtcgcatattgccggctatacgctggaaggcaaagcgcgcggcaccacccaggtctttgaggcgtatagcgcgtttatcggtcgcgagcagcgtgtcgcgctggagacattactgcctgcgcctgagtttggtcgtattacgcttcacggcccgctggatcaaccgacgctgaaaagactggcgcatttggtgtatgatgtgcgccgcgacgatgcgccactgcgtaaagtcgctggaattccgggtgaatttgataaattgcgtaaaaattatcttgagcgccgtgaatggtcgtctttatacgtgatgtgtgacgacgaaacggcagccgccttgctgtgtaagctaggttttaacgctgttcatcacccggcacattaatgtcttcttaatgctccctgtcgaataatgcgacagggacgcttatgtatttctggagtaaatcaccatgtctgaaggctggaacattgccattctgggcgcaacgggcgccgtaggcgaagccctgcttgaaacactggctgaacgccagttcccggtcggtgaaatttatgcgttggcgcgtcatgaaagcgcgggcgagcacctccgttttggtggcaagtcggtcattgtccaggatgcggcggactttgactggacgcaggcgcagttggcgtttttcgttgccggcgcagaggcatcgactgcctggatagacgacgcgaccaatgcaggttgcctggtgatagattccagcggtctgttcgcgctggagcctgatgtgccgctggtcgtgccggaagttaacccgtatgtactggcggattaccgtaaccgtaacgtgattgcggtcgccgatagtctgaccagtcaactgctggcggcgctcaagccgttaatcgatcaggggggactgtcgcgcatcgccgtcaccagtatgttatcagcgtccgcgcaggggaaaaaagcggtcgatgcgctggccggacaaagtgcgaagctgcttaacggcataccgattgatgaagatgatttctttggccgccagttggcgttcaatatgctgccgctgctgccggatcgggaaggcagcgtgcgccaggaacgtcgtatcgtcgatgaagtgcgtaaaattttgcaggatgatggcgtgatgatctccgccagtgtcgtgcagtcgccggtgttctatggccatgcgcagatggtgagctttgaagcgctccgtccgctggcggcggaagaggcgcgcgaggcgttttcccgcggtgaagatatcgtactgtcagaagagacggattacccgacgcaggtgggcgacgcttccggcaatccacagctctctattggctgtgtgcataatgattacggtatgccggaacaaattcagttctggtcagtggcggacaacgtgcgtttcggcggcgcgctgatggccgttaaaattgcggagaagctggtgcaggagtatctgtactgatgtccggacagcaatcatcgccggtctataaaattgcgctgggtattgagtacgacggcagcaagtattatggctggcagcgtcagaatgaagtgcgcagcgtgcaggaaaagctggaaaaagcgctctcgcaggtggcaaatgaacctattaacgtgttctgcgccgggcgcaccgatgccggcgttcacggcaccgggcaggttgtccatttcgaaacgaccgcattgcgcaaagatgcggcatggacgctgggggtaaatgcgaatttgcctggtgacattgccgtgcgctgggtgaaaactgtaccggatgattttcacgcgcgatttagcgctacggctcgccgttatcgctatatcatctacaatcatcgactgcgtcctgcggtattagcaaaaggcgtgacgcattactatgagccgctggatgcagagcggatgcatcgcgcggcgcagtgtctgcttggcgaaaatgattttacctcgtttcgcgcggtgcagtgccagtcgcgcacgccgtggcgtaatgtgatgcacatcaacgttacccgccacggcccttatgtggtggtcgatatcaaagcgaatgcctttgttcatcatatggtcaggaatattgtcggcagcctgctggaagtaggcgctcacaaccagccggagagctggatcgcagagctgttagcggccagggacagaacgctggcggcggcaacggcgaaggcggaagggctatatttggttgcggtggattaccctgaccggtttgaccttccaaaaccgccaatgggcccgctatttctggcggactaatccgaatcgcacacccgaaacgtgtcgggtagaaaggcaaagacaaatatggacctgatctactttattattgattttattctgcacatcgatgtgcatctggcggagctggtcgcggagtacggcgtctgggtgtacgctattttgtttttgattctgttttgtgaaaccggcctggtcgtcacgccgttcctgccgggcgactcgctgctgtttgtcgccggggcgctggcttcgctggaaaccaacgatctcaatgtgcatgtcatggtggcgttaatgctgatcgccgcaattgtcggcgatgcggtaaattacacgattggtcgactgttcggcgaaaaactgttcagtaatccgaattcgaaaattttccgccgcagttatctggataaaacccaccagttttatgaaaaacacggcggtaaaactatcattctcgctcgcttcgtgccgatcgtcagaacctttgcgccgtttgtggcagggatggggcacatgtcctatcggcattttgccgcctataacgtcatcggcgcgctgctgtgggtgctgctctttacctacgccggttatttcttcggtacgataccgttgattcaggataaccttaagctgctgattgtggggattatcgtggtttcgatattacctggcgtcattgagattgtccggcataagcgcgctgcgtcgcgtgccgcaaaatagaaagtaactcaacggttcgaccacttttttatccaaagtttcgggctgttatgttttaatgtgcaacattcatggtctgttgggggcaaaaatggcattatgcgccccttataataaagctgactaaggttcaggcagaaaggtcaccaatgagctggattgaacgaattaaaagcaacattactcccacccgcaaggcaagcattcctgaaggggtgtggaccaagtgtgatagctgcggtcaggttttataccgcgctgagctggaacgtaatcttgaggtctgtcctaagtgtgaccatcatatgcgcatgtcggcgcgcaatcgcctgcatagcctgttagatgaaggttcccttgtggagttgggtagcgagctggagccgaaaaacgtgctcaagtttcgcgactccaaaaaatataaagacagactggcgtccgcgcagaaagaaaccggcgagaaagacgcgctggtggtcatgaaagggacgcttcacggtatgccggttgtcgccgccgcgtttgaattcgcgttcatgggcggctcaatggggtctgtcgttggcgcacgcttcgttcgcgccgttgaacaggcgctggaagacaactgtccgttagtgtgtttctctgcttccggcggcgcgcgtatgcaagaagcgctgatgtcgctgatgcagatggcgaaaacctcggcggcgctggctaaaatgcaggaacgtggtctgccctacatctcggtattgaccgatccgacaatgggcggcgtttccgccagttttgcgatgctgggcgatctcaacatcgccgagccaaaagccctgattggcttcgccggcccgcgcgttatcgaacaaaccgttcgtgagaagctcccgccaggattccagcgcagtgagttcctgatcgaaaaaggcgctattgatatgatagtccgccgtccggaaatgcgcctgaagctggcgagcattctggcgaagctgatgaatctgcccgcgccgaacccggacgccccgcgtgaaggcgtggtggtgcctccggcgccggatcaggagtctgaggcctgataactgaaaagggcagggccgcaggctctgcccttttgcttttcaccgtaaagaagcagcggaatcaatgaaaaacaaatctatacctcaagctgcgtcgcccctggcctcgtggctttcttatctggaaaacctgcacagcaagagtatcgatttaggccttgagcgcgtaagccaggtggcagcgcgtctggacatcctcaagcctgcgccgttcgtttttaccgttgcgggaaccaacggtaaaggtacgacctgtcgaacgctggagtcggtgttaatcgcggcgggataccgtgtgggcgtctatagttcacctcatctggtacgttacaccgagcgcgtgcgcgtgcaggggaaagaattagcggaatccgcgcataccgcgtcctttgcggaaatagaagcggcgcgcggcgatatttcattgacctattttgaatatggtacgttgtcggcattgtggctgtttaaacaggctaaccttgacgtggtgattctggaggtcgggttgggcgggcgcctggacgccacgaacattgtggatgccgatgtagcggtaattaccagcatcgcgcttgaccatactgactggctggggccggatcgcgaaagtattggccgcgagaaggccgggatttttcgtgcggaaaaacccgctatcgtcggcgaaccggaaatgccggcaaccatcgcggatgtcgcgcaggagaccggcgcgctgttgctgcgtcgcggcgttgactggcgttatgaggtgacagcgacccactgggcgtttaccgatggcgacggcacgcttgccggactgccgttgccgcaggttccccagccgaatgccgccaccgctctggccgcgctgcgcgccagcgggttgaacattgacgaacaggcgattcgcgacggtattgcgcaggctaccttgccgggacgttttcaaatcgtgagtgagtcgccgcgcgttatctttgatgtcgcccataatccccacgcggcggaatacctgacgggtcgtctgaaaatgttgccgaaacgcgggcgcgtgcttgcggtgattggtatgctgcatgataaagatatcgccggcacgttagcctggttgaaaagcgtggttgacgactggtattgtgctccgttagaggggccgcgcggcgcgacggcggaacaacttctggaacatctggggaaagggaatgtctatgatagcgtcgcgcaggcatggcaggccgctatcgacgcggcgcagccagaagataccgtgctggtgtgcggatcgttccacaccgtcgcacatgttatggaagtgatagacgcggggagaatcggtggcgagtaagtttcagaatcgtttagtcggcacgattgtgttagtcgcgctgggggttattgtgcttcccggtctgctggacggacagaaaaagcattatcaggatgaatttgctgcgattccactggtaccgaagcctggcgaccgtgatgagccggatatgatgcctgccgcaacgcaggcgctgccgacacagccgccggaaggggcggctgaagaggtgcgggcgggagatgcggcagcgccgtcgctggacccgtcgcgcatggcgtctaacaatgtcgagcttgatccgataccggtggagacgcctaaaccgaagccggttgaaaagccgaagccgcagcctaaaccgcaacagccggttgtcgccgtttccacgccgacgcccgcgccgcaaccggctaccgacgataaacctgcgccgaccggcaaagcctatgtcgtacagttgggcgcgctgaaaaacgcggataaagtcaacgagatagtcggcaagcttcgttccgccgggttccgggtttatacttccccctcaacgccggtacagggtaaaataacccgtattctcgtcgggccggatgcgtcgaaagataagatgaaaggatcgcttggcgagctcaagcagatttccgggttaagcggcgtggtgatgggatatagcccgaactaaggcgcgttttgcctgagcgcgcagcgttaaggcctatggtgttcatctggtaatagccgaagttctgtaggctggataaggcgtttacgccgccatccggcagaaggaataaaccgggtatcctgcgcttatcaggccgatggcagctcttctggtcgtgcccgaagagataaaaagtgtgatggcgttgaatattttttcagcgccatttttatttacgcgtgggaaggaaatccctacgcaaacgttttctttttctgttagaatgcgccccgaacaggacgacagggcgtaaaatcgtgggacatctatggtctggattgattacgccattatcgcggtgattgctttttcctgtttggttagcctgatccgcggctttgttcgtgaagcgttatcgctggtgacgtggggttgtgctttctttgtcgccagtcactactacacttacctgtctgtctggtttacgggctttgaagacgaactggttcgtaatgggattgctatcgcggtactgtttatcgcgacgcttatcgtcggcgctatcgtgaattttgtgataggtcagctagtagaaaagaccggcctgtcgggaactgaccgggtgttggggatctgtttcggcgcactgcgaggcgcgctgattgtcgccgccattctgttcttccttgatacctttaccggcttgtcgaaaagcgaagactggagcaaatcgcagctcatcccgcagttcagcttcatcatcagatggttctttgactatctgcaaagctcgtcgagtttcttgcccaggacgtaacaggttctgagatgtggcttaacgaggaaaatgacgtatgtgcggtattgtcggtatctccggtgttatgccggtcaaccagtcgatttatgacgcgttaacagtgctccagcatcgtggtcaggatgctgccggtatcatcaccattgatgcgaataactgcttccgcttgcgtaaggcaaacgggctggtgaacgatatttttgaagctcgccacatgcagcgtttgcagggcaacatggggatcggccatgtgcgctaccctaccgcaggcagctccagcgcttcggaagcgcaacctttttacgttaactcgccgtatggcatcacgttggcccataatggcaacctgactaatgcgcacgagctacgtaaaaagctgtttgaagaaaagcgccgtcatatcaacaccacctccgattccgaaatcctgctcaatattttcgccagcgagctcgacagcttccgtcactatccgctggaagccgacaatatttttgccgcgattgccgcgactaaccgtcaaatccgcggcgcctatgcctgcgtagcgatgattatcggccacggcatggtggcttttcgcgatccgcacggcattcgcccgttagtgctgggcaagcgtgacgttggcgatggtcgtacggagtatatggtcgcttctgaaagcgtggcgctggatacgctgggctttgaattcctgcgcgatgttgcgccaggcgaagctatctatattaccgaaaaggggcaactgttcacgcgccagtgcgcggataatccggtcagtaacccctgtctgttcgagtacgtttattttgctcgcccggactcctttatcgacaaaatctccgtctacagcgctcgtgtgaatatgggcaccaaacttggcgaaaaaatcgctcgtgaatgggaagatctggacatcgacgtcgtgatccctatcccggaaacctcctgcgatatcgccctggaaattgcccgtattctcggcaagccgtaccgccagggatttgtcaaaaatcgttacgtgggacgtacctttatcatgccgggccaacagctacgccgtaaatccgtgcgccgtaagctcaatgctaatcgcgcggaattccgcgataagaacgtcctgctggtggatgattccatcgtgcgtggcaccacatcagagcagatcatcgagatggcccgggaagctggcgcgaagaaggtttatctggcgtccgccgcgccggaaattcgtttccccaacgtctatggcattgatatgccgaccgccaatgagctgatcgcgcatggtcgcgaggtggatgagattcggcagatcatcggcgcagacgggcttatcttccaggatctgaacgatctgatcgaagccgtacgcgcagaaaacccggatatccagcagtttgaatgttcggtatttaacggggtatatgtcaccaaagacgtagaccagcaatacctcgacttcctggattcattacgtaatgacgacgccaaagcggtgctgttccagaacgaaatggaaaacttggaaatgcataacgaaggctaatggctttgccagcggcgcgatgccgctggccgatgtcaattacgcaccacgccgaagcgaatagcgtatttttgtactttgtactgtaacgtggtgcgggatacgttaaggctacgggccgcggcggcaatgttcccctgatgcgtatccagcgcggtttctattaaatgcctttcgtagttggcaacccgtacctccagcgacccttcatactgcggatcgggtgacgagggaaggggattctccggcgcggtttccggtacgcctaaatttaactcgtcctgttcaaaaatgatgtgtttcagcagcccgtctttttcctgcatgatcatgctgcgtacaatcgcgttttccagcatcctgacattacccggccaggcgtgattgagcagatcagcacgcgccgtctcgcttaatccgtgaatgtcctgcggcacgtcattacggtatttatcaataaaataattcgccagtaaggggatatcttccgggcgggcgcgcaacggcggtaacgtcaacattccgacgctcaaccgataaaaaagatctgcccgcaggcgttcttgttgaattaatttgacgggcgcttcgttcatggcggcaacgatcctgacatcagagtggagttgctgttgtccgccgagccgccagaaggttttatcctgcaagaatcgcagcagcttactttgcatttctatcggcatggcgttcagctcatcaagaaagagcgttcccccgtttgccagttccagatagccctggctattttccgcgccggtataggcgccgcgcacggtgccgaaaagcgtactttcgataagcgtaggcggtagagcgccgcagttcagggcgataaatggcttattcgcccgcttgctgcattgatgtatcaggcgggaaaatagctccttacccgttcccgtctccccgacaatcgtcaccggaatattactggcggccagccgtttggctttggcgatattactgagcatttccggattttcggtaataatggcatggtgcttctcatggtgatcggcatacagcagttggttcagttctaccacctgctcctggagccgcctgacgccggacatattcctgccgatttcgataacgccgaccatgccgccatcgcttgcatagagcgacgcggtggtgtgctgatagtcaacggcctggcctcgcgcattgtaataaatttgataatggccaatgtattccacgcctttttttaacgatgaaagcatcgtactttgggtttctttcatgcccggatagacatccagcatatgttttcccattgcccgttcaatgctgtagccgtccagatccgcgctttcctgattgtagtaaacgtattcaccacgctcattaatgacggccaacggctgatgaatcaaatcgaaaaagcgggaaaacatcctgagcgccgaggccagttcctgattggtggatgccatacatgcattcctcatatctattgttcatgttgccattataaaaatgacgaattttcgtcgttatgatgaatagcaaacttaatgacgaaaatgagaaacagcttatttttataaataattgattattttgataaaaaatagtggcatgccttttgctttatccctgtaaagaatgcggatttttaccataaacattaagcagagggcgttatgactgactcgattatgcagaattacaaccagctacgtgagcaggtaatcaacggcgatcgccgtttccagcacaaagacggtcatttgtgttttgaaggggtcgatctggacgctctggcgcgccagtaccccacgccgttctatgtgttttctgagccggagattattcgtaacattcatgaaatccagcaggcatttgcggcgcataaaaataccaaaaccttctttgcgtcaaaaacctgctcggtcatgggagtgttgaaagccattcgtgacgccggaatttgcgcggaggcaaactcacaatatgaggttcgcaagtgcctggagataggctttcgcggcgatcagatcgtcttcaacggcgtggtgaaaaagcctgccgatctggaatatgccatcgccaacgatctgtatcttattaatgttgatagcctgtatgagctggaacatattgatgccatctctcgcaagctgaagaaagtcgccaatgtttgcgtccgcgtagagccgaatgttccctcggcgacgcatgcggaactggttaccgctttccatgcgaagtcgggtctcgacctggaacaggcggaagaaacctgccgccgcattctggcgatgccttatgtgcatttacgcggcttgcatatgcatgtgggcgatcaggtgccggagtcagagcctttcgcaaaagcgactaaagtgctggtggatgaatcccgtcgcctggaagaggtgctcggtattaaatttgatttgatcaacgtgggcggcggaattccggttccctataaatatgacgacgagaatggcgacccgttaaaagataatatgtatgccggtattaccgcccaggattttgccgatgcggtcattcgcgaagtgcataaatggcgtaccgatgtggaaatatgtattgaaccgggacgtaaagtgaccgggtcggcggcggttttactgacggaagtctcctgcgaaaaacgtaaaacaaattacgatcttaacggcaatgtggaatgccacgttgaatggaaatttgtcgatgctggttacagcgtactctctgatagccagcattttgactggttcttttatgtctataacgcctctcgcatgacggcagcgcacgacgcctggataaaattagccgggccgctgtgtgatggcggggattatttccacatgggagtgaaaggcgaagagtttttactgccgaaggagactcatgttggcgatattgtcgcgtttcttgatgccggggcatacaccattgaaagtcaaaccgtttataacaaccgtccgcgcacgggggtggtgatgatcgataaaaatggtgagacgcgtctgattcgtcgggaagacagttacgaagatatggtcaagtacgacatttattaatactgttttgggcttcagtttcatgctgaagcccgtcgtcagatgataagaagagggcagtgatgcctgaatgcataacaggagatggccatgagtaacacgaattctggcttacttggcatcaaagacattgtctttatgaatgtcatcgctattctgagtttgcggcaaatccctaacgtggcgccttacggggcatcggccatgttgctatgggtgatagccgcattctgcttgttttttcctttagcgatggtatgcggcgagctgtcaaccggctggccgaaagatggcgggatatttgtctggattaaagaggcatttggtaaacgtattgcatggattgtcgtggtttgttttctcttttcctgcgtactgtttttcccattaatgctgcaattcggctttaccgcgttgggctatatgatcggcggcggcctggcggaaaataaagcgtttatcggtattggttccgcggtaattttctggctattaacgctgatgaatatccgcgggatggaatggacaaaaattattaatagcatcagcgcctggtgcgacgtatttattccctccgccatcctcattttgctggcggtggtatggctatgtaccggacaccagatgcagacggactacactacagcgaaaaactggattccggatctcggacactgggatacgatcgttttcttatccagcatgatgtttgcgtttgccggactggaggtcgccccgatgattgccgggcgtacccgtaatccacagcgtgattttccgcgagcgatggccgtctctgccgccgttatcgttgggatctatatggtcggcacctgggcgctaaatacgcttttacccgccgggaaaaccgacatcgtggcaggcgtcatgcaggctatgcatgctgctgcggacacgctgcatatgccgtggttaattcctgttatggccatctgtatgttttttggcgctctcgggcagattaactcctggctggtggggccgatttatatgctccaggaagcctcgcgtgaagataatctgctgggggaccgaatcggcaaattacatccggtgtggaaaacgcccgcctttgccttgactatacaggcgattattgtcacggtcctgtgtttttcgacttttatttcgccaagcgttgcggcggcttactggatgttaacggcgctaacgaccatcacctattttattccttatctggtgatgttcccggcgttctggcgtttacgtaagactcagccagatacgccaagaagttttaaaattccgggcaaggttttaccggctattttacccgcgctgggctttctttctatcgcctttgccgttgcgctgttatttattccgccttctcaaattgatatgggcggatatttccagtacgccgggaaaattattggcggagccgtgctggcggttgtcgtcgcggagtacatttaccatcgggcgcagaaacgtaatgcccgtttaagcatggcgggaggaaaataaaatgtatatgccagttctggaaataaatctacgcaagctggaagaaaacgcacgcacggaaaaagctctgctggcaagcagcggtattgacgtgatggctgtcaataaagtttttgacggctgcgtggaaaccgcgcaggcggtgttaaacggcggaattaccgttattgctgaatcacgaacctataatttgaaaaaaatacgcgagacaggatgtacgacctgcctgttacgcagcccgtgtctgagtgaaatcgaagatgtggtgcgctacgcggatattagtttaaatagcgagccggtggtattacgggcattatcgcaagaagcccaacgccaggggaaaacgcatcaggtattactgatggtgaatatgggcgatttacgcgagggtatctggtttggtgaatatcaacgcattcttgagaccgtgactctgattactggtctgcccggtctggaattatatggactgggcaccaactttaattgttacggcaccgtgttgccaacggtaaaaaatggcgaggattttctggcgctggccgcccggctggaagctgacagcggtattcctgtccggcggctttctgcgggaaactgcaccagctatcacctgctggataaaggtatctggccgcagggactgaatcatctgcgcatcggcggactgcatgaattcggcattgaatatgtggacatgaaatacctgaatgaatttcaccactccgcaaaaccggtcgataaagcctgttccgatatgtatatcctggaagcggaaatcatcgaactgaacagtaaaccgaccgtcccggtcggggagctgggcgtcgatgcctttttgcaaagtaaaacctttgtcgatcgtggcatacgccgacgcgcattgctggcgtttggtcgtcaggatgtgccgtcggataactgtgtgccatgcgacgacgctatcactatcttagggcaaaccagcgatcatacgctggtggatattgaagattgtcgtcagtcgctaaaagtaggcgatgtggttcgctttgagctggattatacgggcctgttaatggcctgccagaccaaaggcgtcgcctggaggtttacgcgttaacgcataaccgccgcggctatgtcgcggcggcatctttgacctcacgaaagacagggagtaacgatggataccctgcaacaatctccgccagcagagcctgaaggcggtctgcggcgtaacctgaagaagcggcacctgctgatgatgtcgctgggcggcacgattggcaccggcttatttatcggcattgccgaaccgttaagcagcgtcgggccggcgggaaccttactggcctatctgtttgccggaaccattatgctggcgacgatgatgtgtcttggcgaattatcatgcgcctttcctcactccggttcatttcaacattacgcgctgatgtttatgccgtcaccttgctggagctataccattggctggctttactggtttagctgggtcttttccctggcagccgacctcactgccgcagggtttattgctcaccagtttttccccgcggttccggtatatatgttctgcctggcgattctgctcatcctgacggctatcaatctcacctccgcaaaaagttttggcgaatgcgaatactggctttcggccattaaggtcttcgcgatcgtgctgtttatctgcgcgggcggggtcatgatctactcgctaatgggccatagtgactggcacccgacgttaaaaacagacggaatgtggtttccccacggttgggagcaaattgtggtctgtatgacgatcgtgatttactccttccagggggtggaactggtcggaaatgcggcaggggagaccgaatcgccgcacattattttaccgaaggtgatcctggggatcggtctcagaatcattttgttttacggcctggcgattgcggtgctggcgctggtctatccgcatgaactgacgccaaatggacaaagtccctttgtatgggtattctcccacgcgggcattccgggggcggatacgctgatgacgctggtgatcttttccgccgcggtttctgccgctaactcggccatttacgccagttcgcgtatgctgtggtctatggcgggcgatcgctttgcgccagcctgctttggtaaaacgaacggcggcggcgtgccggtgtatgctattttaatcacgaccttgctggcgttggtgtcgttgctgacccgctatattcccgcacagcaattttatttatatctgatcgccagtaccgggcaggtgggttgcctggcatggataaccatcggatggtgccagtatcgcttccgacaatcggtgcgtaatggcacgtacgccagcgatttgctacgctatcgatcgccgctttttccctggacggcccgatttgtcattatcaccaattttgccattatggtcggcacctagtttagtgagcagggagtagtgataatgttggttgagctggcttttatgatagggattcttttgtcatggtatctcttcagacccactttgagccggttacgtaacacagtgggatgaacggcgctcgtaaacggtaagaggacatgaaacgactcattgtaggtattagcggcgccagcggagcgatttatggcgtgcgcttattacaaattttgcgcgatgtcgatagcgtggaaacgcatctgatgatgagccaggcggcccggcaaacgctggcgctggagacccatttttcgctgcgcgaggtgcaggcgctggccgatgtgacgcacgatgcgcgcgacattgccgccagcatttcctccggctcttacccgacggcaggaatggttatcctgccctgttcgattaaaacgctgtcggggattgtccacagttatactgacggactgcttacccgcgcggcggatgtgatattaaaagagcggcgacctctggtgctgtgtgtgcgcgaaacgccgctgcatatcgggcatttgcgtttaatgacccaggccgctgagataggcgcggtgattatgccgccggttccggctttttatcaccttcctcagacgttagatgatgttataaatcaaacggttaaccgagtgttggatcaatttgacatcccccttccgcacgacctttttgttcgctggcagggcgcatagcgttgtctgtttagcgtgcattattgtccctgttgccctgtttcagggcaattttgtaaccgcgatcatatcctcaacatttaattcgttaaaagccgccgaaacgctgcggttcaaccgtcatacctgctatcttcaacatcaggacaatattgcaacgttttattaacaaatttaacgtcgaatcgttttgctgacgtgaaaatggcataagacctgcatgaaaaagtctgcaaacacacaacgccacgtaaaacataaaaaaatgacgccacttgaggggtatgtatgaagaagaccgttctcgctttgtctttgctgataggtctgggcgcgacggcggccagttacgccgcgctcccgcaaacggttcgtattggaacagataccacctacgcgcctttctcatcgaaagatgccaaaggcgactttattggctttgatatcgatctcggtaatgaaatgtgtaagcgtatgcaggtgaaatgtacctgggtcgccagcgactttgatgcgcttattccctcactaaaagcgaaaaaaatcgatgccattatttcatcgctctctattaccgataaacgccagcaagaaattgcgttttccgacaaactttacgcggcggattcacgcctgattgcggcaaaagggtctcccattcagccgacgctggaatcgctgaaaggcaagcatgtcggcgtgctgcaagggtccacgcaagaggcttacgccaatgataactggcgcactaaaggtgtggatgtggtggcttatgccaaccaggatcttatctattccgatttaaccgccggtcgtctggatgccgcattgcaggatgaagtcgccgccagcaaaggtttcctgaagcagccagcgggcaaagagtatgcgtttgccggtccttccgtgaaggataaaaaatattttggcgacgggacgggggttgggctgcgcaaagacgataccgagctaaaagccgcgtttgataaagcgctgaccgaactgcgccaggacggaacttacgacaaaatggccaaaaagtacttcgattttaatgtctacggcgattgagggaaggggataacgcgccgcgctggggaactatcacggtgcaaaatagatgttttgcacctttttggtgcataagccgttgcggaacaggcgcataaatgcatacttaatcgatttttatgcaaaataaaccggctgacaaggtagaatgctttgccttgtcggcctgattaatggcacgatagtcgcatcggatctgtaaagatctcctggaaagacagtctgttgaggatagttatgaaaaaactggcgttatccctttctctggtgctggcattttccagcgctaccgcagcatttgccgctattccacaaaagattcgcatcggtaccgatcctacatacgcaccgtttgaatccaaaaatgcacaaggtgaattggtcggctttgatatcgatctggccaaagaactgtgcaaccgtatcaacacacagtgtacgttcgtggaaaacccgctggatgcgctgattccgtctttaaaagcgaagaaaattgatgccatcatgtcctcgctgtccatcactgaaaagcgccagcaggaaatcgcgtttaccgacaagctttacgccgctgattcccgtctggtggtggcgaagaactctgatattcagccgaccgtcgcgtcgctgaaaggcaagcgcgtcggcgtgctacaggggacgacgcaggagaccttcggcaatgagcactgggcgccgaaagggattgagatcgtctcttaccaggggcaggacaacatttattccgacctgacggctggccgtattgatgcggcgttccaggacgaggtcgcggccagcgaaggtttccttaaacagcccatcggaaaagactataaattcggcggcccggcggtgaaagatgagaagttattcggcgtaggaaccggtatggggctgcgcaaagaggataacgagctgcgcgaagcgctgaacaaagcctttgctgaaatgcgtgctgacggtacttacgaaaagttggcgaaaaagtactttgattttgatgtttatggcggttaatcaccgtcggtgcagataaagcccaaagaatattgactgtctgcattgcctgagggcgctgtgcgcgtcaggcctacggggagcatcgtaggccgggcaaggcacagccgccatccggcgtgatgtgaggcaaaaatgcaaaagaggcttcttacttcaccacacacaacaggacaggctgcatgttgtacgggttttcaggcgtaattttacagggcgcgatcgtcacgctggaactggcgctcagttccgtggtgctggccgtgcttatcggtctcgtcggcgcgggggcgaagctttcgcaaaaccgggtaacggggcttatttttgaagggtacaccaccctgattcgcggggtgccggatctggtattaatgctgctgatattttacggattgcaaatcgcgcttaacgtggtgaccgattcgctgggtatcgaccagatagatattgatccgatggtggccggtattatcacccttggtttcatctacggcgcctattttaccgaaacctttcgcggcgcgtttatggcggtaccgaaaggccatatcgaggcggcgacggcctttggttttacccacgggcaaaccttccggcggattatgttcccggcgatgatgcgttacgccctgccggggatcggcaataactggcaggtgatactcaaagcgacagcgctggtgtcgctgctgggcctggaagatgtcgtcaaagccacgcagcttgccggtaaaagcacctgggagcctttctattttgccgtggtctgtggacttatctacctggtatttaccaccgtttccaatggtgtgctgctcttacttgagcgtcgctattccgtaggcgtgaagagggccgatttgtgattgagatcattcaggagtactggaaatccctgctgtggacggatggctatcgttttacaggcgtggcgattacgctgtggttgttaatttcatcggtggtgatgggcggtcttctggcggtgattctggcggtgggtcgcgtttccagtaataaattcatccgttttcccatctggctgtttacgtatatttttcgcggcacgccgctgtacgtacagctactggtgttctattcggggatgtatacgctggagatagtcaaaggcaccgatcttcttaacgcgtttttccgcagcggactgaactgtaccgtactggcgctgacgctgaatacctgcgcatacactacggagattttcgccggagcgattcgttcggtaccgcacggtgaaattgaagcggcaagagcgtatggcttctcgtcatttaaaatgtatcgctgcattattttgccgtcggcattacgcatcgccttgcctgcctacagcaacgaagtgattttaatgctgcactctacggcgctggcgtttaccgcgacggtgccggatttgttgaaaatcgcccgcgatattaactcagcgacttaccagccgtttaccgcgtttggcattgccgccgtgttgtatttactcatttcgtatgtcctgataagcctgttccgccgggcggaaagacgctggttgcagcacgtgtcctctaaataattcgagtaacatgatgtcagaaaataaattacacgttatcgatttgcacaaacgctacggcggtcatgaagtgctgaaaggggtatcgctgcaggcccgcgccggagatgtgattagcattatcggctcgtccggttccggtaaaagcacttttttgcgctgcattaacttcctcgaaaaatcgagcgaaggcgcgattatcgtgaacggtcagaacattaatctggtgcgcgacaaagacgggcagctcaaagtggcggataaaaatcagctacgcttgttgcgtacccgcctgacgatggtgtttcagcactttaacctctggaaccacatgacggtgctggaaaatgtgatggaagcgccgattcaggtactgggattaagcaagcacgacgcgcgcgagcgggcgttgaaatatctggcgaaggtggggattgatgagcgcgctcagggcaaatatcccgtccatctctccggcggccaacagcagcgcgtttctattgcgcgcgcgctggcgatggaacctgacgttttactgttcgatgaacccacatcggcgctcgatcctgaactggtcggcgaagtgttgcgcatcatgcaacaactggcggaagaaggcaaaacgatggtggtggtcacgcatgaaatgggcttcgcccgccatgtctcttcgcacgtgatttttctgcatcaggggaaaattgaagaagagggcaatccggagcaggtgttcggcaatccgcaaagcccgcgtttacagcaattcctgaaaggctcgctgaaataaaagaagcccggcggcgcatcgcttaccgggcaggatacggcgctttgggaattagcgaatcacatccgccagcgcctcttctaaatcataccagcgaaatgcgaatccggcggcttcaagccgttttggcagcgcccgctgtccgcccagtaccagcactgacgactctcccatcaataagcgaattgccgtcgccggaatgcgaataatcgccgggcggcgcagcgcgcgacccagcgcatgagcaaactgctcattatggacgggatacggcgagaccatattgaagggaccgcgaagatcgttatccagcagccacaggatgccgttgaccatatcgtcaatgtgaatccaggccagatattgccgaccattacccaccggaccgccgagtccgaggcgaaacggcggaaccattttccccagaatcccgccttgcggcgccaggacaacgccggtacgcagcaggcagacgcgggtctggtcgctctgcgcacgacagacaatctgttcccagcgggcgcaaagtttatgcgtaaattcgttgtgcggcggctcatcttcagtgacgacaacgtcgcccagatcgccgtaatagcccgtggcggagccggatatcaacaccgagggcggcgtagcgctggcatgaattaaatccaccaacttttgcgtgatagcccagcggctttggcacaaccgttctttttgttgcgacgtccagcgcttgtcggcaatcggttcgcccgccagattgatgatggcatcaatctcattgaggtgctcacgttccgccagccctttccataatgtcactctggaatcgagaatctgacgcgcgttatcgggattgcgcgtaacgaccgtcacctggtgccccagtattaacagccggggaatgagatgacgccctatcaggcccgtaccgccggtaatcagaatctgcatatgacctccagagtagggaggatttcctcttccctaatgtcaggtttttaatacgaataagggtgccggacgcaggttttccgtgtatacacctctacatcatacatgatgtatgctaccgcgttacgctttcgtactgttacagtgcagttgcgcttgtaacagtgcgcgcgctgtcgcaggacgcgtgcgaatgcgttcaaaccagttatacaccgccgggtaagtatcaagatcgattcgctgacgctgatgtgcgttaacccacggccaactggcgatatccgcaatactgtagtggtcgccgcccagccacggggaggtttccaggcgtttattcaggacgttgtataagcgttgcgtttcaacctgatagcgttcaatcgcataggggatggcctgtggcgcaaagtggttaaagtgatgattctggcccagcatcggccctaacccgccgacctgccagaacagccattgcagcgtggtatggcgttcacgcagctccccgctaagcagtttgccgcttttttccgctaggtagagaagaatttcgccggattcaaaaagactaagcggttgaccgccgtctgccggggcgtgatcgacgatggcaggaattttattattgggagagatagccaaaaaatcagggcgaaactgattgcccttgctgatatctacttttagcaaacgatacgccagctccgcctcttccagaaacagcattattttatgcccgttgggcgtgggggcgtagtaaaggtcaatcattttggctcctgcatgtgcgtaaagagtctgggctgaattaagtatagaaagcctcctgatgtgtgtgagttttcatcaggtgacagcaggcgaaagacgctatattttgggaagaaacctaatacgccctcaagaggacattatgagtaagcctgttattgtgctgtggtcggatgcgaactttttctctccctacgtcttgtccgcctgggtggcattacaagaaaaagggctttcctttactctgaaaacccgcgatctggaccagggagaacatctgcaacctggctggcggggatatgcgctgacgcagcgcgtcccggtgcttgaggccgacaattttgagctgagcgagtcgtccgctattgcggaatacctggaggagcgtttcgcgccgccgcagtgggagcgtatctacccgcacgatttacaaaaacgcgcccgcgcgcgacagattcaggcgtggctacgcagcgatttactgccgcttcgcgaagaacggcctaccgacgtggtgtttgccggggcgaaaaaagcgccgctaagcgaggctggaaaagccagtgcggcaaaactgtttgcgacggctgaagcgctattggggcaggggacgcaaaatttatttggtgaatggtgcattgccgataccgatctggcattgatgatcaatcgtctggtgctgcatggcgatgacgtgccggcgtcgctggcggcgtatgcgacatttcagtggcagcgtgcttccgtacagcgttttattgcgctttcctcgaagcgttcaggctgaaaatctattcatattccagtatcataacgccgtttttcacaatgaggagtgagcgatgaaactgatgttcgcatcggacattcatggttctttacccgccacggaacgcgtgcttgagcggttcgcgcaaagcggcgcgcgttggctggtgatattaggcgatgtccttaaccacgggccgcgcaatgcgctgcctgaaggctatgcgcccgcccaggttgccgaacgcctgaacgcggtggcgacgcaaatcattgccgtgcgcggcaactgcgatagcgaagtggatcagatgctgctgcatttcccgataactgcaccgtggcagcaaatattgacgcaagagaggcggctatttttaacgcatgggcacctcttcgggccgacgaatctgcccgctctgcatactggcgatgtgttggtctatggtcatacgcatctgccggtggcgcaacagcaggaaggactgtatcactttaatcctgggtcagtgagcatcccgaaaggcgggtatgcagcaagctacggtattctggatgataatgtgttgagcgtaatcgcactcaatgatcaaagtatcattgcgcaggttgcaattaactcgtaatttacctcacaaacgtaaatgcgccgtaagagcgccagaaataagaaggtttcctgatggtggaacagcgtcgtttggcaagtacggaatgggtggatattgtgaatgaagacaatgaagtcattgcacagtccagccgggaacagatgcgtgcgcaacgcttacggcatcgtgcgacgtatatcgtcgttcatgatgatatgggtaaaattctggtgcagcgtcgtaccgaaacaaaagattttttgcccggtatgttagatgctaccgcaggcgacgtggtccaggctgatgagcagctactggaatctgcccgccgcgaagcggaagaagagttgggtattgcaggcgtgccgtttgccgaacacggtctgttttactttgaagaccaacattgccgggtttggggcgcgctgtttagctgcgtttcccacgggcctttcgcgcttcaggaagatgaagtcagcgaagtgtgttggctgactccggaggagatcaccgcgcgctgtgatgaatttacgccggactcgctcaaagcgctggcgctgtggatgacccgcaacgccaaaaacgaagccgcgcttcaggagaaaccggaagagacggaataagcgttttagcagctttcccgcatacataaactggaggcgatagattttcgatcgctccagtttccctgatttaacctttccaacagcgcccgtccggcttcactgccaatcttacggtgcggtacggccatggtggttaacggcggctggcagacccggctgacatcgctatcgccaaacccgaccaccgctaaatcgtccggaactttgatccgccgtcgttggcactcgtataacgcgccgcaggccagctcatccgatacgcataccagcgcgtccagctccggccatgctagtaaaaactccggcagttgcgacgcgccggtagaaaaattgggcggcaaggcggcattaatcacccggtttggcgacatatggtggcgaagcatcgctttgtaccagccgtgcagatgttgctgaaaaatccactgctcctgattggcgcatagcagcccgatattctggtaaccgcgctgaatcagcatttccgtcagctcatacattgctgcaacgttatcaataccgatattcatatcaataggatcgctgcgaatcgcgcccatctccatcaccggaatagaggcatttttcagccactggcgcacggtagtgctatgttcgacgctaagcagaatcgccgcggcaatgttggaagccagcagcgtttcgagcagcttctcctcttgttccacgcgatgctgcgattccgccagcattatctggtagcctgcgggctgtaaaatttgttgcagcccggcgaacatttcagaacaccccgcttccgcaaggttcggtacgaccatcgcgatggtgtgcgaggaggcagacgccagcgcgctggcggcgagattaggcatatagcccagctcatgcactgccgcttcgattttttcccggagtttatcagagacctgttccggcgtgcgtaaggctcgtgatacggtcatcgtgcctacaccggcaagttgggctacatcggcgatagtcactttaccggtactgcgccgtttacggggtatcgacatacaaattcctgcgtcattacaacatgttgagatgcttttttattgtcgttctttgcttcgcatgactggcagtatacgccttaaatccgcttttttgctgtgatttcacaccatgattttaatttgatagcgctatcacaattctgagtaatagtcgctggtagcgctatctttgtgataacgatcgcagctaatatcgaatggcttgaataaagtttgttcataatttcatacaccgtgggggcgaataacatgctgggaacctggttatctgacgcaaccatcacgctacgggagagcgtggaaacgtggccgcaagcgctggaaatttgcggcaaacccctgctggacgcaggtgttatcgcaccggaatacattacggcgattgttcagcagcaccaaaagcttgggccgtattatgtattagcgccagggttagcgatgccgcatgcgaggccggaagagggggcgaaagggttaggtttatcgttactgaaactacagcgcggcgtttcatttggcgcagacgaattcgatccggttgacatcattattatgctggcggcgcctgataagcacagtcatatcgaaatgatatcggctctggcggaattattttccagtgatgtagatatggaaaaattacatcaggcaaaaaacctggaggacattaaaacgattattgaccgtttctgattttattccattttcttgcggtaaataacattgcgcccgtgcgtgatgcagaccaactctacttttaaaaggtgacaataatgaaaatcatggcaatttgcggttccggcctgggtagtagttttatggtagaaatgaacattaaaaaagtattaaagaaactcaatattgacgctgaagtggaacactccgatctctcatcggccacacccggggctgccgatctttttgtaatggccaaagatatcgcggccagcgccagcgtaccggaaagccaactggtggtgatcaataacatcatcgacatcaacgaactggaaacgcagctgcgcgcatggttcgctaaacaataattattgctggcgaggtggatatgtttatccttgaaacgctgaattttgttgttgatattttaaaagtgccatcggtgcttgtagggttaattgcgctgattggtctggtggcgcagaaaaaagcgttttccgatgtggtaaaaggcacgattaaaaccattttaggttttattgtgcttggcggtggcgcaaccgtactggtgggttcattaaacccgctagggggtatgtttgaacacgcttttaatattcagggtattattcctaataatgaagcgatagtctcaatcgcgctggaaaaatatggcgcgtccacggcgttaattatggcatttggtatggtggccaatattgtcgtggcgcgctttacgcgtcttaaatatatctttttgaccggacatcacaccttttacatggcctgtatgattggcgtaatcctgaccgtggcggggtttgagggcgtagggctggtcttcaccggatcgctaatcctggggctggtgatggccttcttcccggcgttggcccaacgttatatgaggcggattaccggtaccgatgacattgcgtttggtcacttcggtaccctgggatatgtgctttccggctggattggcagcctgtgtggtaaaggctcccgctccacggaagagatgaacctgccgaaaaacctcagttttttacgcgacagttctatctcgatttcgctgaccatgatgattatctatctgatcatggcagtcagcgcagggcgtgagtatgtcgaagcgacgtttagcggcgggcaaaactatctggtgtacgccattatcatggcaatcaccttcgccgccggcgtattcatcattctgcaaggcgtccgtctgattctggcggaaattgttccggcctttaccggcttttcagaaaaactggtgccaaacgcgcgtccggcgctggactgcccggtggtgtatccctatgcccctaacgcggtactgattggcttcctgttcagttttctcggcgggctggtggggctgttcctgcttggacagatgaagcttgtgttaatcctgcctggcgttgtgccgcacttctttaccggcgcgaccgcaggcgtctttggcaatgccaccggcggtcgccgcggggcgatgatcggcgcatttgctaatggtctattaatcactttcctgccagtgctgttactgccggttctcggcgcgatcggcttcgccaataccacgttctcggatgctgactttggcgtaatcggtattttgctgggcaacctggcgcgttatctgtcgccgatggctatcacggggctggtggtggcgctattcgcgctactggtggcgtacaacgtgttggccaaaagcaaaaaagcgactgccgaagtgcaggaaaatagcggagcgaaagaatgaacgtaaccgaaatcacccaactggcgcgcgacattcgcgtcgccacgctcaaatccttaaaccatcttggctttggtcactatggcggcagcatgtcggtagtggagactctggcggttctgtacggcgcggtgatgaaaatcgaccctgccgacccggactggccggagcgcgattacttcgtactgtcgaaaggccatgcgggccccgcgttgtacagtaccctggcgattaaaggctatttcccgcgcgaagagctgaatacgcttaaccagaacggcacccgtcttcccagccatccggatcggctaaaaacgcacggcgtggacgccacgaccggctcactgggacaaggcatctctattgcgggcggaatggcgttgtcgtataaactggcgcggcgacccaaccgggtattttgcattgtcggcgatggggagctgaatgaagggcagtgctgggaggcgtttcagtttattgcccaccaccgcctgaataatctgaccgttttcattgactggaacaaacaacagcttgacggcgagctggaggagattatcaatccattcgatctggaagggaaattccgcgcgtttggtttcgatgtcgtcaccgtcaaaggcgatgatatcgccggactactggcggtggttcagcctgtgccgcccgctgatgcccggccacgggttgtgatccttgacagcattaaagggcagggggtgccatgcctggagcagttaacgaattctcaccacttacgcctgacggatggcatgaagcagacgctcaatgaggccattcatcaactggaggtcatgcatgattaagcttgcgcccgcagggcttaaagacgatatcgaaatgcgcaaagtttatgccggttttgtcgccgggcagattgaggccggaagcccaattattgcgcttgaggctgatttaatgagctcgatggcgatggacagcgtggcgcgtgactacccgcagcatgtcattaactgcggtattatggaggcgaatgtgattggcacggcggcgggactggcgctgaccggtcgcaaaccgtttgtgcatacctttaccgcttttgccagccgtcgctgttttgatcagctctttatggcgctggattatcagcgtaacaacgtcaaagtgatcgcctccgatgccggagtgacggcgtgccataacggcggcactcatatgtcttttgaagatatggggattgttcgcgggctggcgcactctgtagtactggaggtgacggatgcggtgatgttcgcgaatattttacgccagctaatggacctggacggtttttactggctgcgtaccatccgtaagcaggcgacgagtatctatgcgccaggctctacctttaccattggcaagggcaacgtactgcgcgagggcgatgatattacacttatcgccaacggcattatggtggcggaggcgctggaggcggcgcgccaactggagcaggaaggcgtgagcgctgcggtcattgatatgttcaccttaaagcctatcgatcgcatgttggtgaaaaactacgcggaaaaaacgcggcgtatcgtcacgtgtgaaaaccacagtatccataatggactagggtcagcggtagcggaagtgctggtggaaaactgcccggtgccgatgcgccgtgttggcgtcaaagagcgttatgggcaggtaggaacgcaggatttcttacaacaagagtacggactcaccgccgcagcgattgtagaagccgcgaaatcactgctttaatcatggagatattgccggatggcgctgatgctcatccggcattttggatcaatgatatcccatcatctgcgcgccaatcacgaccacgctggacatgataaacagcagtcccagcagcgacgcccccactttaagccagttgcgaaaatcgacccggcacacgcccagcgtggccatcagcgaagctgatgtcggatagataatatggctgaagccatcgccaaactggaaggcaagaacagtcacctgacggttaacgtcgaccagatcgccgagcggcgccagtaatggcatggttaacgccgcctggcccgaaccggacgtgacaaagaaattaaataccgcctggaagagcagcataaaccaggcggcgatagcattattaagcccgctgatgccatgcgcgatactgttaagcaacgtattgagcacgctgggttccccggcttcgccgttgccgaccagcagcagaatgcctttggcaaaacccaccagcaaggcgggcgcgatcatcatcctcgccccttcggtgaatgaggacgccatcacgttgaccgtcataccgttgaggcggaagataacgccgatgaggccgatcaccacgcccatggtgaaaaactggctggcgatctccggaataaaccaggcgtggacaatcacgccccagacgacccaaatcattacgccggtcagaaccagcagtaccagccagtcgccgaaggtgaaagggcgctggacgacttcatcctgctgttcgcggaaatagcgatcggattcgtggacgcgggaaagcagcggattctttttcacgcgtgaggcgtagaccagcgtaaaaaccagcccaatcagcgtggcgacaatccagaccacaatacgcagcccggagccggaaagtaccggcacgccggcaatcccctgggcgacgactacgcaaaacgggttcatccacgaactggcaaagccaatttgggtggcgatataggtcaccaggacggtggtaatgctgtcatagcccagcctgaccatcagcggggctatgataattgcaaaggcgaccgcctcttcgcccatgccaaatacggcgccccctaacgaaaagaggacaaatagcaccggaataaacaggacttcgttgccccgcgtgtggcgaataagcgccagaatgccgttatccacggtgccggtacgcatcacgatgccgaatgcgccgccaatcaccaacataaacataatgatgccgacggcagtgccgaatttcgatccggatgttaacccttcaaacggaaaattcatcagccctggtctttcatcgccggtagtgaaaaattgtacgcgatgatactgcgcttctccggcctcattggtcacaatgcgaaaagagtgcgggtcgacgactttgcgggtttttgtctgaccatcgacctgatactgcacttcctggctatcaaacatcccaacggggacgacccaggtggcgatactggttaaaatggcgacaaaaaagatgatgaccagcgtatcgggcattgcccattttctggctgtttttgattctgtaacgacagacatgacggactatccctgttgcaaagcaaagaggccaagtatgagaagaagggaatagttattcattgatgcagcgcagttaagcaaaaaattccgctttgcagggtaaatagcagaatgccggatggcgatgctaacgcgtcttatccggcctacaacggtatctcacctgtaggccggacaaggcgttcacgccgccatccggcattagcttttactgttactgctgctgttgagaagcctggatcgccgtcagggcgatggtgtagacgatatcgtcaaccagcgcgccacgggacaggtcgttcaccggcttgcgcataccctgcagcatcggcccgatggagatcaggtcggcagaacgctgtaccgctttgtaggtggtgttaccggtgttcagatccgggaaaatgaacacggtagcgcgacccgcaaccggcgagttcggcgctttggatttcgctacgtcagccatgaccgcggcgtcgtactgcaacggaccgtcgatcatcaggtcaggacgtttttcctgcgccagacgcgtcgcttcacgtactttctctacgtcgctgcccgcgccagaggtgccggtggagtaggagagcattgccacacgcggttcgatgccgaaggcaatggcggaatccgcagactgaatcgcgatttctgccagctgctctgcagtcgggtctgggttgattgcgcagtcgccgtaaacgtaaacctgttccggcagtagcataaagaacacagaagagaccagggagctacccggcgccgttttaataagctgcagcggcggacggatggtgttggcggtggtatgaaccgcgccggaaaccaggccgtcgacttcgtcttgctccagcatcagcgtgccgagcaccacgttgtcttccagctgttcgcgggcaaccggttcggtcatgcctttgctcttacgcagctcaaccaggcgagcgacatagctttcacgcaccacttccggatcgacgatttcaatacctgcgcccagctctacgccctgagatgccgcgacgcggttgatttcatccgggttgcccagcagtacgcaagtggcgatgccgcgttcagcgcagattgccgccgctttgacggtacgcggttcgtcgccttccggcagcactacgcgtttaccggctttacgcgccagctcagtcagttggtagcggaacgccggcggagagagacgacggctacgctcggaagtggcggtcagcgactcgatccagtcagcgttaacgtagttcgcgacgtattcctgaactttctcgatgcgctcatggtcatcaaccggaacttccagattgaagctttgcaggctcagcgaagtctgccaggtgttggtgttcaccataaagaccggcagaccggtggcgaatgcgcgttcgcacagtttagaaatgcgcgcgtccatttcatagccgccggtcagcagcagggcgccgatttctacgccgttcatcgcggccaggcaagctgcgaccagtacgtccggacggtcagctgaggtcactaacaacgatcctgcgcggaaatgctccagcatatgcggaatactgcgcgcgcagaacgtaacggatttaacgcggcgggttttgatatcgccttcgttaatgatggtggcgttcaggtgacgcgccatatcgatagcgcgggtcgcaatcaggtcgaagctccacggcaccgcgcccagaaccggcagcgggctggattcctgcagtttagcaggatcgattttgatcacctgcgctttggaagagtcgtcaaaaatctctgacagatccgggcgagtacggccttgttcatcaaccggcgcattcagtttgttgatgataacgccggtgatgttggtgtttttcgcgccgccgaagctgctgcgcgtcagttcgatacgctcgttcagctgttctggcgtgtcggtaccctgagacatgacaaaaacgatttccgcattcagcgttttcgcgatttcatagttcagagactgagcgaactgatgtttacgggtcggaaccagaccttcaaccagcaccacttccgcgtctttggtattcgcatggtagtttgcgatgatctcttccatcagcacgtctttctggttgctggagagcagagattcaacgtggctcatcttcagcggttcagccgccggcagggtagagttcgcgcgaacgatagtggtggtctggtcaggcgcatcgccgccagcgcgaggctgggcgataggcttaaagacgctcagacgaacgcctttgcgttccatagcacggatgacgccgaggctgacgctggtcagaccgacgctggttccggtagggatcagcataataatacgggacacggtttatcctctttcgttaccgtcttttggggacgggttacaaaacagcaccgccagcgaggctggcggtgtgaaatcaggcagtcagacggctcgcgtcctgcgcgataaccagttcttcgttggttgggatcaccaccgccggacgggtaccttctttgttgatgaaaccagatttgccgaagcgggccgccaggttacgttcgtggtcgacttcaaagcccagtacgcccagtttgcccagagacagctcgcgaaccatcgcggcgttttcaccgataccgccggtgaacacgactgcatccagacgaccgtccatcagagcggtgtaagaaccgatgtatttcgccaggcggtggcagtaaacgtccatcgcacgttttgcgtcttctttggtggcgtagttgtcttcaacataacggcagtcgctggtcacttcagtcagacccagcagaccggactctttggtcagcattttgttgatctgatccacgctcatgcccagagtgtcgtgcaggtggaagataatcgcagggtcgatatcgccggaacgggtacccatgaccaggccttccagcggggtcagacccatagaggtatccacgcatttaccgttacggatagcggaaacagaaccgccgttgcccaggtggcaggtgataatgttcagttcttctaccggcttgttcagcatttttgccgcttcctgagttacatagaagtggctggtgccgtgtgcgccatagcgacgaacgccatgttctttatacaggctgtacggcagggcatacaggtaagattcttccggcatggtctgatggaaggcggtgtcgaacacggcgacgtttttatctttcagctgcgggaaagatttcagcgcttcggcgataccaatcaggtgagccgggttatgcagcggtgcgaaagaggcggaatctttgatgccctgaatgacggactcatcaatgactacggagctggtatacttctcgccgccgtgtacgatacggtgaccaattgcagttaactgcgcagacagttctggtttttgtgccagaatagtgttaacgataaagttcagcgcttcactgtgagcggcgcctgcacctaaagccgcttcttgtttactgccgtccattttccatttgatgcgtgcttctggcagatggaaacattcggctaaaccagaaaggtattcatcaccattaactgcatcaataattgcaaatttcagtgaagaactaccgcagttcagaaccagtactaacttactcgacatggaagtacctatttatgatacgtggctaaaaaaacgtcagtgagccatagagcgtagcgcatgatagccctgacatttatgattaacatcatgcgcaggagtttttttgggcatgatggaagaaatacctttgagtctatgccattttgcgtatttttcagccaatggcatactatgtgtaatattgacgactcaatgattttaaactaccggcctttgacaggccgacacaggatacctgatagtgggtatcgaagacaaaatgttttgaacgttgtccctcgcagttgttgttttgcacaaattttttaaattttatatgtgaaattgaggtaggccatgtcgacgccggataatcgctccgtaaatttttttagcttatttcgccgggggcagcactacgcgaagacgtggccgatggaaaagcggctggcgcccgttttcgtcgaaaaccgcgtcattcgtatgacgcgctatgccatacgatttatgccgcctgtcgccgtctttacattatgctggcagatagcgctgggcggtcagttaggtccggccgtggcgaccgccctgttcgccctgagcttgcctatgcagggattatggtggttagggaaacgttccttgacgccattgccgccttcaatccttaactggttttacgaagttcgcggtaaattgcaggaggctggacaagcgctggcgccggtagaaggaaagccggattaccaggcattagctgacacgcttaagcgcgccttcaaacaactggataaaactttcttggatgatttgtaattgaccccggattacgcatataaaagaaggcataccaatgccttctttttttcatcgccatagcgtgatacaggagttcaaaatggaaatgaccaacgcgcaacgtctgattttgtctaaccagtacaaaatgatgacgatgctcgatcccaccaacgccgagcgttaccgtcgcttacaaacaattattgaacgcggctacggcctgcagatgcgcgagctggatcgcgagtttggcgagctgacggaagagacctgtcgtaccatcatcgatattatggagatgtaccatgcgctgcacgtctcctggaccaacctcaaagatacgcaagccatcgacgaacgtcgcgtcaccttcctggggtttgacgccgcgacggaagcgcgttacctcggctatgtccgttttatggtgaatatagaaggacgctacactcactttgacgccgggacgcacggctttaatgcccagacgccgatgtgggaaaaataccagcggatgttgaatgtctggcatgcctgcccgcgtcagtaccacctgagcgcgaatgaaatcaatcaaatcattaatgcctgaggaggctcacgtgcagtgtaaaggttttctgtttgatctggatggaacgttggttgactcattacctgccgtcgaacgcgcgtggtgtagctgggccgatcgttttaaccttgctcatgatgaggtgctgggctttattcatggcaaacaggcgatcacctcgttgcggcattttatggcgggtaaatcggaggcggaaattgccgctgagtttacgcgcctggagcaaatagaagccactgaaaccgcagggatcaccgcgttgccgggggcagtcgatttactcaatcacctgaataaagcgggcattccgtgggctatcgtcacctccggttcaatgccggtcgcgcgtgcgcgccatcaggtcgcgggccttccagcgccagaggtgtttgtcaccgccgaacgagtcaaacgcggcaaaccggagccggatgcgtatttgctgggcgcacaactgcttggcctggcccctcaggagtgcgtcgtagtagaagatgccccggctggcgtgctgtccggactggctgcgggctgccacgtcattgcggtcaatgcgccggccgacacgccgcgtctggcggatgttgattttgcgttggatagcctgacgcaattatcggtcgctaaacaaccaaacggcgatgtggtggtgttaagaaagacctgatcatgatatgccccgccctggcggggcatatttatggcagaatcacgttatcttctcatctgacaaggatatgttgtgaacggtgaattgatttgggttctctctttactggcgattgccgtcgtgttgtttgcgacgggcaaagtacgtatggatgcggtggctttattcgtcattgttgcttttgtccttagcggtaccttgaccctttcggaagccttctccggctttagcgatccgaatgtcattcttatcgccgccttatttattattggcgacggcctcgtgcgcaccggcgttgcgacggtggtcggtacctggctggttaaaatggcgggcagcagtgaaatcaagatgctggttttactgatgatcaccgtcgccggacttggtgctttcatgagttcaaccggcgtggtggcgatttttatccccgttgttcttagcgtttctatgcatatgcagacctcgccttcgcgcctgatgatgccgctgagttttgccgggcttatcagcggaatgatgacgctggtggcgacgccgtcgaacctggtggttaacagtgaactgctgcgtgaaggcctgcacgggttcaacttttttagcgtgacgccgctgggggtagtggtgttggcgctcggcattgtttatatgctggtgatgcgcttcatgctaaaaggcgatgcgcccggacaacaggccggtaagcgtcgcactttccgcgatcttatccgcgagtaccgtctgacggggcgcgcgcgtcgtctggcgattcgccccggttcgccgatggtgggacagcggctggacgaccttaaactgcgcgaacgttacggcgccaatgtcatcggcgttgaacgctggcggcgctttcggcgggttatcgtcaatgtgaacggcgtatcggagtttcgcgctcgcgacgttctgctgattgatatgtcggcggcggaggttgacctcagagagttctgcgccgagcaactgctggaaccgatggtattgcgtggagaatatttttccgatcaggcgttggatgttggcatggcggaaatttcgcttattccgaagtctgaactgataggcaagtcggtgcgtgaaatcgccttccgtacacgttacgggctgaatgtggtcggcctgaaacgcgacggcgtcgcgctggaagggtcgctggccgatgaaccgttattgatgggcgatatcattctggtcgtggggaactggaagttaatcagcctgctggggcaaaaaggccgcgactttgtggtgctgaatatgccggtcgaggtcagcgaagcctcgccggcgcacagccaggcgccgcacgccattttctgtctggtactgatggtggcgctgatgttgaccgatgaaattcccaatccgagcgcggcgattatcgcctgcctgctgatggggaaatttcgctgtattgatgctgaaagcgcgtataaagcgatccactggccgagtattatcttgattgtgggtatgatgccgtttgcgctggcgttgcaaaaaaccggcggcgtctctctggtcgtgcaagggttaatggatatcggcggcggctatgggccgtatatgatgctgggatgcctgttcgtgctgtgcgccgtcataggactgttcatttctaacacggcaacggcggtgctgatggcgccgattgcgctggcggcggcgaaatcgatgggggtgtcgccctatccgtttgcgatggcagtagcgatggcggcatccgccgcctttatgacgccggtttcatcgccggtcaatactctggttctggggccgggaaactatagctttagcgattttgtgaagcttggcgtgccgttcacgcttattgtgatggcggtttgtattgtgatgattccgatgttgtttccgttttaaccccaggctggaaaaggcctgatggcgctacgcttatcaggcctacgggaagaacggtaggccggataaggcgttagccgccatccggcaactaaagcggtgaatcctggcttatctcgtcaagagagagatggaaacttggcacgaacaccgccataaaatagtccatctcctggctgcgacgtaattccagcgttttttccagccgcgtttttgccagtctaaactcattatttcccgctgagagctcctccaggcatttcaggtaggcgcaaagcgcatcggcctgctttacgattgcctgttcttctttgctccaggcattctcatcaataagcggtgcgaaaatatcgtgtaattcatccggcgccatatcaaccagcttttgctgggcgattttttcgatcgctttatattcctgagctatctgggaattaaaatattttaccggcgttggcagatcgccggtcagtacttccgaggcatcatgatacatcgccagaagcgcgatgcgttcagcattgagctggccgccaaatttacggttttttatcgccgccaacgcatgggcgaccatcgccacctgcagactatgttcggagacgttttccgtacgcacgttacgcatcagcggccagcggttaatcaacttcatgcgggagagatgggcgaaaaaatggctctgcttcatagattaccttttgttttcactgcggcagacttcattgtgcggggagggtgatgaagatgcaattcaggctaccgaagtagcctgaatttaagattattgatggtagcctgagaggaaacgcccaaagcggttgatggccatctccaggtcatcttcacgcggtagcgtcacaatgcggaagtgatccggccacggccagttaaaggcggtaccttgcaccagcagcaccttttcctgtagcaggaagtccagcaccatcttctggtcgtcgtgaatattaaaacgtttagcgtcgatcctggggaacatgtacaacgcgccgcgcggttttacgcaggaaacgccgggaatatcgttaatcaactcccaggcgcggttacgctgttcatacagtcgaccgcccggcagaataaattcgctaatgctttgatagccgccgagcgcggtctgaatagcatgttgcgccgggacgttggcgcacaggcgcattgaggctaacatctccagcccttcaatatagcctttcgcatgttttttcggcccgttcagcaccatccagccctggcggaagccggcgacgcgataggttttagacaaaccattaaaggtgatggtcagcagatcaggcgccagtgcggcgatagagtgatgttcggcatcgtcatagagaatcttgtcataaatttcatcggcgaagatgatgagattatgctcgcgcgcaatgttgacaatttccatcagcaattctttagaatagacggcgccagtagggttgtttggattaataatgacaataccacgcgtacgtggggtgattttggcgcggatatcgtcaaggtccgggaaccagtcggaagattcatcgcaaagataatgtaccgccttgccgctggagagcgataccgctgctgtccataacggataatcgggcgcgggaaccagcatttcatcgccactgttaagcaacgcctgcatcgcctgaacgatcagctcggaaacgccgttaccgatatagatatcttccacggttacatcgcgcattccacgggcctgataatgctgcataatcgctttacgggcggaataaagccctttcgagtcgcaatatccttgcgccgtcggcaaattacgaatgacatcgaccagaatttcgtccggcgcttcgaatccgaagggggcggggttgccgatattcagtttaagaactttattaccttcttcctcaaggcgtttcgcttctttcagaacggggccacgaatgtcataacagacattttcgagtttgctggatttttcaatgggggacatgaatcttgaccttttagctgttattgccactccctgccgtggaagtcagcacgaaacaatgtactcccacgacggtgagttttgaagagtgaacagaagaagattttgtttatttttaacgcgctttcgtactgtttaaaacttcataaaatcatttggttagatgcattttctatttttgtctgtatgtatagtgttttgttctatgtggttgcgcgtaatgtggttttttatgttgtcagaaattatctgttttatgagagataagcattcatcattagtgtcgcgtcggctatttcggaaatactgagtattaaaggtaaaatgagaaggttagacctttccggcggcgggtggtgtgaaactattgttaagtataattaatgaatggtagaaatcttaattaattattatttaatatttaaaaagcatttactaaagtcgtaataatatctttctggtcggattagtataacatatcccaggttaagattattcgtaataatacttataaatatagcggttttaggttaagataatgatccgaaacgggggcgtagtctgcgttgtctgctaattatcatgacgcgattttatacataacctattgttcaatatattgtttttgtatctgtgcgtctcggtaaactatttgacgctgttacaagatttacacgtccatcattagcagaaatctgtagacgcctaaaggtatgacacattctctttgatatatcccgatcagttgcatttggtattatatcagtaagtaagagaagtgttttggtcgtattttcaattacattctaacatttacctgggtaaccaggcggtactgcgaaggatgcacattacaaatggaattgcttgtttctgaatgcacagcattaaccaggtcagcccgatatgacccgtcagtaagtgaaaaattatgataaatgcaaatcgtccgataattaacctcgatctcgatctgctgagaacgttcgtggccgttgccgatctgaacaccttcgccgcggcggcggcggcggtatgtcgtactcagtctgcggtcagtcagcaaatgcagcgtcttgagcaactcgtgggaaaggaattgttcgcccgccatggtcgtaacaaacttttgagcgaacacggtatccagcttctggggtacgccagaaaaatcctgcgttttaatgatgaggcgtgttcatcattaatgttcagtaatcttcagggagtgttaacaatcggcgcttctgatgaatcagctgatactatcctgccttttttgcttagccgaatcagctcggtttatccgaaactcgcgcttgatgtacgggtaaaacgcaacgcctatatggtggacatggttaaatcgcaggaagtagatttggtggtgacgactaaccaacctcattcgctggactgtctgaatttgcggacctcgcccacccattggtattgtgcggctgagtatgttttgcaaaggggagagcccgtaccattagtcctgctggacgatcccagcccattccgcgatatggtgctggagacgctaaatgcagcgggtattccctggcggctggcctatgtggcctctacattactggcggtacgcgcggccgttaaagccggtcttggcgtaacggctcgacctgtcgaaatgatgagtcccgaccttcgcgtgctgggcgccgcagatggattaccgcctttgctggatacggaatatatgttgtgccgcgatcccaatagccagaacgagctggcgatggtgattttccatgcgatggaaagctatcaaaacccatggcattacaaccagttttctgcagagggcggagatgatccgctgatggtggaagggggttttgagtagctcgcaggcaaaaggcgctaagtcgtaaatgtaaaaaagagccgctggcgatgaaaaaacgctcagtggctctttttttgtgcccatctgtacgcgcttaaccgcacaaattgtaaaagttgcggtaaatcagccagtagcgattcgcagttcaatgtgggcaaaaaataaccagaacatccattttatgaatttgcatgttaaaaaactagagaaattgttgctgttttagggggtgaattaacaaaagcgtgtcacagatcaagaaaatactcccatttagggggaggcatcttcacaaattcctgtcaaaataggtgtgtgttatttcttttgcttcacaacggacacgattcaacaacataaaatctcccctggtcgaagagtcattttctccaggatggcacttaatgttaatgatgatgaattgatgtaaattaatgtgaaggaacttttgttaaagttgacaaaaggttatagaaaggagtaaaaaaccacatcaattagctgtttttatcattttctacagtaattgtagggtttttttattcctcccctgaatcgatgtggcgtccatctgccgtaaagagcagaggaactggcgctacttttgatgagtaagcaatgagtatgtcaacatccactgaagtcatcgctcatcactgggcattcgctatctttcttatcgttgccattggcctgtgctgcctgatgctggtaggcggttggtttttgggcggtcgcgcacgcgcgaggcacaagaacgttccgtttgaatcaggtatcgactcggtcggcaccgcccgcttacgcttgtctgccaagttttacctggtagccatgttcttcgttatcttcgacgttgaagcgctgtatctgttcgcatggtcaacttctatccgcgaaagcggctgggttggctttgtggaagctgcaatttttatttttgtgttactggctggtctggtttatctggcgcgtattggcgcgttggactggacgcccgcgcgttcacgccgcgagcgtatgaacccggaaacgaacagtatcgctaatcgtcaacgctaaccgcgaggcattaagatggattatacgctcacccgcatagatcctaacggtgagaatgaccgttaccccctgcaaaaacaggagatcgtaaccgaccccctggagcaggaagttaacaaaaacgtgttcatgggcaaactgcatgacatggttaactggggccgtaaaaactcaatttggccctacaacttcggcctttcttgctgctatgtagagatggtgacctcgtttaccgcagtgcatgacgttgcccgtttcggcgcggaagtgctgcgtgcgtcgccacgtcaggctgatctgatggtggtggccggtacctgctttaccaaaatggctccggttattcagcgtctgtatgaccaaatgctggagccaaaatgggtcatttctatgggcgcctgcgccaactccggcggcatgtacgatatttattcggtagtgcagggcgttgataagtttatcccggtggatgtgtatatccctggctgtccgccgcgtccggaagcgtatatgcaagcgttgatgctgctgcaagaatcgattggcaaagagcgccgtccgctctcatgggtggtgggcgatcagggcgtgtatcgcgccaatatgcagccagaacgcgaacgtaaacgcggcgagcgtattgccgtcacgaacctgcgtaccccggacgagatttaatttgcgcctgtcggcagcagcacttcacttcgctaaccactattttaatagcgcgaagcactgccgaccaccacggaccatttgcaatggtgaacaatatgaccgacttaaccgcgcaagacgctgcatggagtacccgcgatcatcttgatgatccggttatcggcgaactgcgcaaccgttttgggccggatgcctttaccgttcaggcgacccgcaccggtatccccgttgtttgggtcaagcgtgaacaactactggaggttggcgatttcttaaagaaactgccgaaaccttacgtcatgctgtttgacttacacggcatggatgaacgcctgcgtacgcaccgtgacgggttacccgccgcggatttttccgttttctaccacctgatttccattgagcgtaatcgcgatattatgctcaaggtggcgttgtctgaaaacgacctgcgcgtgccgaccttcactaaacttttccctaacgccaactggtacgagcgtgagacctgggagatgtttggcattgatatcgaaggccacccgcacctgacgcgcatcatgatgccgcaaacctgggaaggccatccgctgcgtaaagattatccggcgcgcgcgaccgaattcgacccgtttgagctgaccaaagccaagcaggatctggagatggaagcgttgacctttaagccggaagactgggggatgaagcgcgggactgacaacgaggactttatgttcctcaacctcggcccgaaccacccgtctgcgcacggtgcgtttcgtattatcctgcaacttgacggcgaagaaatcgtcgactgcgtgccggatatcggctatcaccaccgcggcgccgaaaaaatgggcgagcgccagtcctggcatagctacattccctataccgaccgtatcgaatacctcggtggttgcgtcaatgaaatgccgtacgtgctggcggtagaaaaactggcggggatcaccgtcccggatcgtgtgaacgtcatccgcgtgatgctctccgaactgttccgcattaacagtcatctgctgtacatttcgacctttattcaggacgtcggcgcgatgaccccggtcttctttgcctttaccgaccggcagaaaatttatgatctggtggaagccattaccggtttccgtatgcacccggcctggttccgtatcggcggcgtcgcgcacgacttgccgcgcggttgggatcgcctgctgcgagagttccttgagtggatgccgaagcgtctggactcttacgagaaagccgcgctgcgtaacaccattctgaaagggcgttcgcagggcgttgccgcttacggcgcgaaagaggcgctggagtggggcaccaccggcgcagggctgcgcgcgaccgggatagacttcgacgtgcgtaaatggcgtccatattctggctacgaaaactttgactttgaagtgccggtgggcggcggcgtttccgactgctatacccgcgtgatgctgaaagtggaagagctgcgccagagtctgcgcattcttcagcagtgcctcgataacatgccggaagggccgttcaaagcggatcacccgctgaccacgccgccgccgaaagagcgcacgctgcaacatatcgaaaccctgatcacccacttcctgcaggtctcctggggcccggtgatgccggcgcaggagtccttccagatggtggaagcgacgaaggggattaacagttactacctgaccagcgacggcagcactatgagctaccgtacccgcgtgcgcacgccgagctttgcgcacctgcagcagattccctcggcgatccgcggtagcctggtctccgacctgattgtctatctgggtagtatcgattttgttatgtcagatgtggaccgctaattatgcacgagaatcaacaaccacaaaccgaggcttttgagctgagtgcggcagagcgtgaagcgatagagcacgagaagcaccactacgaagacccgcgtgcggcgtccattgaagcgctgaaaatcgttcagaagcagcgtggctgggtgccggacggcgcgatctacgctattgccgatgtgctgggtattccggcgagcgacgtcgaaggcgtcgccacattctacagccagatcttccgtcagccggtcggtcgccacgtgattcgctactgcgacagcgtggtgtgccatatcaccggctatcaggggattcaggccgcgctggaaaaaaatctcaacatcaaaccggggcagacgacctttgatggccgctttacgctgctgccgacctgctgcctggggaattgcgataaagggccgaacatgatgattgatgaggatactcacagccatctgaccccggaagccattcctgaactactggagcggtataaatgaaaaacgttatccgtactcccgaaacccatccgctgacctggcgtctgcgcgatgacaaacagccggtctggctggatgaatatcgtagcaaaaacggctacgaaggcgcgcgtaaggcgctgaccggcctgtctccggatgaaatcgtcagccaggtaaaagacgctggtctgaaagggcgcggcggcgcgggcttttccaccggtctgaagtggagcctgatgccgaaagatgaatccatgaacatccgttacctgctgtgtaacgccgatgaaatggagccgggcacctataaagaccgtctgctgatggaacaactgccgcacctgctggtggaaggcatgctgatctccgcgttcgcgctgaaagcgtatcgtggttacatcttcctgcgcggcgaatatatcgaagcggctgtacatctgcgccgtgcgattgccgaagcaaccgaggccgggctgcttggcaaaaatatcatgggcaccgggttcgacttcgaactgtttgtccacaccggggcagggcgttacatctgtggtgaagaaacggcgctgattaactccctcgaaggccgccgcgcgaacccgcgctccaagccgcctttcccggcgacctccggcgtatggggcaagccgacctgtgtgaataacgtcgaaacgttgtgtaacgtcccggcaatcctcgccaacggcgtggagtggtaccagaacatctcgaaaagcaaagatgcgggtaccaagctgatgggcttctcgggccgcgtgaagaatccgggcctgtgggaattaccgttcggcaccatcgcgcgcgagatcctcgaagactacgccggcggtatgcgtgacggcctgaaattcaaagcctggcaaccgggcggcgcggggacagacttcctgaccgaagcacacctcgatctgccgatggaattcgaaagcatcggtaaagcggggagccgtctgggcaccgcgctggcgatggcggtagaccacgaaatcggcatggtgtcgctggtgcgtaacctggaagagttctttgcccgcgaatcctgcggctggtgtacgccatgccgcgacgggttgccgtggagcgtgaaaattctgcgcgcgctggagcgtggcgaaggccagccgggggatatcgagacgcttgagcaactgtgtcgattcctcgggccgggtaaaaccttctgcgcgcatgcgccgggcgcggttgagccactgcaaagcgcaattaagtatttccgcgaagaattcgaagctggcatcaagcagccgttcagtaatacccatttaatcaatggtattcagccgaacctgctcaaagagcgctggtgagttaacgatttttaatttggaagcatgctaatggctacgattcatgtagacggcaaagaatacgaggtcaacggcgcggacaacctgctacaggcatgtctgtccctcggccttgatattccgtatttttgttggcacccggcgctgggaagcgtcggtgcttgccgccagtgtgcggtgaagcaataccaaaacgcggaagatacgcgtggtcgcctggtgatgtcctgtatgacgccagccaccgacggtacctttatctctattgacgacgaagaagcgaaacagttccgtgaaagcgtggtggagtggctgatgactaaccacccgcacgactgtccggtctgtgaagagggcggtaactgccatcttcaggatatgaccgtgatgacgggtcacagtttccgccgctaccgtttcaccaaacgtacccaccgcaaccaggatctggggccgttcatctcgcacgaaatgaaccgctgcatcgcctgctaccgttgtgtacgttactacaaagattatgctgacggtaccgatctgggcgtctatggcgcgcatgacaacgtctacttcgggcgtccggaagacggtacgctggaaagcgaattctccggtaacctggtcgagatttgcccgaccggcgtcttcaccgataaaacgcactccgagcgttacaaccgtaaatgggacatgcagtttgcgccgagcatctgccagcagtgttccatcggctgtaacatcagcccgggcgagcgctatggcgaactgcgccgtatcgaaaaccgttacaacggtaccgttaaccattacttcctctgcgaccgcggtcgtttcggctatggctatgtgaacctgaaagaccgcccgcgtcagccggttcagcgtcgtggcgatgactttattactctcaacgccgagcaggcgatgcagggcgcggcggatattctgcgccagtcgaagaaagtgatcggtatcggttcgccacgcgccagcattgagagcaactttgcgctgcgtgagctggttggtgcggaaaacttctacaccggtatcgcgcgcggcgagcaggaacgtctgcaactggcgctgaaagtgctgcgtgaaggcggaatttacaccccggcgctgcgggagatcgaatcttatgacgcggtactggtcttgggtgaggatgtcactcagaccggcgcgcgcgttgcgctggcggtacgccaggcggtgaaaggtaaagcgcgtgaaatggcggcggcgcagaaagtggccgactggcagattgcggccatccttaacatcggccagcgtgccaaacatccgctgttcgtgactaacgtggacgacacccgtctggatgatatcgccgcctggacttatcgcgcgccggtggaagatcaggcgcgcctgggctttgcgattgctcatgcgctggacaatacagcgcctgcggttgacggtatcgacagcgacttgcaaaacaaaattgatgtcattgtgcaggcgttggccggcgcgaaaaaaccgctgattatctccggcactaacgccggtagcagtgaggtgattcaggcggccgccaacgtggcgaaagcgctgaaaggccgtggcgccgacgtcggtattactatgattgcccgctccgtgaacagcatggggctgggtatgatgggcggcggttcgcttgacgatgcgttgggcgagctggaaaccggcagcgcggacgcggtggtggtgctggaaaacgatctccaccgtcatgcaagcgctacgcgcgtgaacgccgcgctcgccaaagcgccgctggtgatggtggttgaccatcagcgcacggcgattatggaaaatgctcatctggtgctttccgcggcaagcttcgccgaaagcgatggtacggtcatcaacaacgaaggccgcgcgcagcgcttcttccaggtttatgacccggcctactacgataacaagacgattatgctggaaagctggcgctggctgcattcgctgcacagcaccgtcgaaaaccgcgaagtggactggacacagcttgaccatgtgatcgacgcggtcattgccgccatgccgcaatttgccggcattaaggacgccgcgccggatgcgaccttccgcattcgtgggcagaagctggcgcgcgaaccgcatcgttacagcggtcgtacggcgatgcgcgccaatatcagcgtgcatgaaccacgtcagccgcaggataaagacaccatgttcgccttctcaatggaagggaataaccaaccgactgccccgcgatctgaaattccgttcgcctgggcgccgggctggaactctccgcaggcgtggaacaaattccaggatgaagtgggcggcaaactgcgtcacggcgatccgggcgtgcgtttgattgaagcgactgagggcggtctggattatttcactaccgtgccggcaagcttccaggcgcaggacggtcagtggcgtattgcgccgtattaccacctgtttggcagcgacgaattgtctcagcgttctccggtcttccagagccgtatgccgcagccgtatatcaaacttaacccggcggatgctgcgaagttgggcgtcaatgccgggactcgcgtctcctttagctacgatggcaatacggtgacgctgccggttgaaatctctgaagggttagcggcagggcaggtagggctgccgatgggtatgcctggcatcgcgccggttctggctggcgcgcgtcttgaggatctgcgggaggcgcaacaatgagttggattacaccggatctgattgagatcctgctgagcattctcaaagcggtggtgattctgctggtggtcgtcacctgcggggccttcatgagctttggcgaacgtcgtctgctgggtctgttccagaaccgttatggaccaaaccgcgttggctggggcggttcgctccagctggtcgcggatatgatcaagatgttctttaaagaagactggatcccgaaattctcggatcgcgtcatctttaccctggcgccgatgatcgcgtttacttcgctgctgctctccttcgccattgtgccggttagccctaactgggtggtggccgatttaaacatcgggattttgttctccctgatgatggccggtctggcggtttacgcggtactgttcgccggttggtcgagcaacaacaaatactcgctgctgggcgcgatgcgcgcgtctgcccagacggtgagctacgaagtgttccttggtctttccctgatgggcgtggtggcgcaggccggttcatttaatatgaccgatatcgtcaataaccaggcgcatctgtggaacgtgattccgcaattctttgggtttgttactttcgccatcgcgggcgtagcggtctgtcaccgtcacccgtttgaccagccggaagccgagcaggaactggcggacggttaccacatcgaatattccggtatgaaattcggtctgttcttcgtgggggagtacatcggcatcgtcaccgtttccgcgctgatggtaacgttgttcttcggtggctggcatggcccgttcttaccgccattcgtctggttcgcgctgaaaaccgcgttcttcatgatgatgttcattttgattcgtgcgtcgttaccgcgtccgcgttatgaccaggtaatgtccttcggctggaaagtttgcctgccgctgacgctcatcaacttgctggtaacggcggctgtcattctgtggcaggcgcaataagggacacaaagaccatgaccttaaaagaattattagtaggtttcggcactcaggtacgcagtatctggatgatcggcctgcatgcgttcgcgaaacgcgaaacgcggatgtatccggaagagccggtctatttaccgccccgttaccgtggccgtatcgtgctcacgcgcgacccggacggtgaagagcgctgcgttgcctgtaacctgtgcgcggtagcctgtccggtaggctgtatctctctgcaaaaagcggagaccaaagatggccgctggtatccggaatttttccgcattaacttctcacgctgcatcttctgcggcctgtgcgaagaagcgtgcccgaccacggcgattcagttgaccccggacttcgaactgggcgaatacaaacgtcaggatctggtgtacgaaaaagaggatctgctgatttccggtccgggcaaatacccggaatataacttctaccggatggcgggtatggcaatcgacggcaaagataaaggcgaagcagagaacgaagccaagcctatcgacgtcaagagcctgttaccgtaaggagagggcaatggaattcgctttttatatctgtggcctgatagccatcctcgcgaccctgcgagtgatcacccataccaatccggtacacgcgctgttgtatctggtgatatcgctactggcgatttccggggtgttcttttcgctgggcgcttactttgccggtgcgctggaaattatcgtctacgcgggtgccattatggtgctgtttgtgttcgtggtgatgatgctcaacctcggcggcagcgaaatcgaacaggaacgccagtggctgaagccgcaggtgtggattggtccggcggttttgtcggccattatgctggcggttattgtgtacgccattctgggcgttaacgaccagggcatcgacggcacgccgattagcgcgaaagcggtgggcattacgctgttcgggccttatgttctggcggtcgaactggcgtctatgctgctgctggcaggcctggtggtggcgttccacgtcggtcgtgaagagcgtgcgggcgaagtgctaagcaaccgcgccgatgaccgcgcgaaaagaaaaacggaggagcgcgcatgatccccttaacacacggactgatcctcgctgcgattttattcgtcctgggtttaaccggtctggttatccgccgcaatctgctgtttatgctgatcgggctggaaatcatgattaacgcctccgcgctggcctttgtggtcgccgggagctactggggccagaccgatggtcaggtgatgtacattctcgccatcagccttgcggctgcggaagcgagtattggacttgcgctgttgctgcaactccatcgccgtcgccagaacctgaacatcgattcagtaagtgagatgcgtggatgaacatgcttgccttaaccattattctgccattgattggctttgtactgctggcgttctctcgcggacgctggtcggaaaatctctccgcgaccattggcgtgggctccgttggtctggcggcgttggtgacagcgtttgtcgggatggatttcttcgccaacggcaaacaggcgttcagccagccgctgtggacgtggatgtcggtcggtaacttcaacatcggttttaacctggtgctggacggcctgtcgctgaccatgctctctgtggtcaccggcgtcggcttcctgatccacatgttcgcttcctggtacatgcgtggagaagagggctactcccgcttcttcgcttataccaacctgtttatcgccagcatggttgttctggtgctgtccgataacctgctgttgatgtacctcggctgggaaggcgtgggcctgtgctcttatctgttgatcggcttctattacagcgatccgaagaatggcgcggcggcaatgaaagccttcgtggtgacccgtgtcggtgacgtattcctcgccttcgcgctgttcatcctctacaacgaactgggcacgctgaacttccgcgaaatggtcgagctggcgccagcgcactttgctgacggcaacaacatgctgatgtgggcgacgctgatgctgctgggcggcgcggtcggtaaatctgcgcagctaccgttgcagacctggcttgccgacgcgatggccggtccgacgccggtctccgcgctgatccacgccgccaccatggttaccgccggtgtctacctgatcgcacgcacgcatggcctgttcctgatgaccccggaaattctgcatctggtgggcattatcggggcgattacgctggtcatggcgggtttcgccgcgctggtgcagaccgacatcaaacgcgtgctggcctattccaccatgagccagattggctacatgttcctggcgcttggcgtgcaggcgtgggatgcggcgattttccacctgatgacgcacgccttctttaaagcgctgctgttcctggcatccggctcggtaattttggcctgccatcacgaacagaacatctttaagatgggcggtctgcgtaagtccattccactggtgtatgcctgcttcctggtggggggcgcggcgctgtcggcgctgccgctggtcactgcgggcttcttcagtaaggatgagatcctggctggcgcgatggcgaacggtcatatcaatctgatggtggcgggtctggttggcgcgttcatgacctccctgtacaccttccggatgattttcatcgtattccacggtaaagaacaaattcatgctcatgcagggaaggggattacccaccatctgccgctgattgtcctgatgattctgtctacctttgttggcgcgctgattgtgccgcctctgcagggggtgctgccgcagacaactgaactggcgcatggtcgtgtgttgaccctggaaattacctctggcgtagtggcgattgccggcatcctgattgccgcatggctgtggctgggtaaacgtacgctggtgacgtcgatcgccaacagcgcgccgggccatctgctggggacctggtggtataacgcctggggctttgactggctgtacgacaaagtattcgtcaagccattcctcggtatcgcctggctgctgaagcgcgacccgcttaatgcgttgatgaacattccggctatcctttcccgttttgcaggcaaaggcctggtactgagcgagaacggttatttgcgctggtatgtggcatccatgagcatcggcgcggttgtggtgctggcgctgctgatggtactgcgttgagtttgttggctggatgaacgactgccggatggcgcagtgcttatccggcctacaaacccaaaaataatttttagaattcgttgaaaatctgttcctgaagtacaggcgtcatcggcgaagtcagaccggataccgccagcgcacagcaaccggagcgtactgaagtacgtgaggatgattcgcgaagctcacccctacggggccgtccttacggacgttcaaaacgcgctgcgttttgtgtgagcactggcaggatttgggctgacgagtgagatagcctgagcaggagtaaatataagggacatacttagctatgttattaccctggttgatattaatcccctttatcggcggctttctgtgctggcagaccgaacgctttggcgtgaaagtgccgcgctggatagcgctgattaccatggaactgacgctggcgctcggtctgcaattgtggttgcagggcggctactcactgacgcaatccgccggtattccacagtggcaatctgaatttgtcctgccgtggattccgcgttttggcatctctatccatctggcgctcgacggactgtcgctgctaatggtggtgctgaccggcctgctcggcgttctggcggtgctttgctcttggcgagaaatcgaaaaatatcagggcttcttccacctcaacctgatgtggatcttaggcggcgttatcggcgtgttcctggccatcgacatgttcctgttcttcttcttctgggaaatgatgctggtgccgatgtacttcctgatagcgctgtggggccacaaagcttctgacggtaaaacgcgtatcacggcggcaaccaagttcttcatttacacccaggcgagtggtctggtgatgttgattgccatcctggcgctggtgtttgtgcactataaagcgaccagcgtgtggaccttcaactatgaagagctgctgaataccccgatgtcccacggtgtggaatatctgctgatgctgggcttcttcatcgccttcgcggtgaaaatgccggtggttccgctgcatggctggctgccggatgcgcactcccaggcgccgaccgccggttccgtcgacctggcggggatcttgctgaaaaccgccgcttacggtctgctgcgtttctccctgccattgttcccgaacgcgtcggcggagtttgcgcccatcgccatgtggctgggcgtcatcggcattttctacggcgcgtggatggcctttacccaatacgacatcaagcgcctgattgcctatacctccgtttcccacatgggcttcgtgctgatcgctatctacaccggcagtcagctggcgtaccagggcgcggtgattcagatgattgcacacggtttgtccgcagccggtctgttcattctgtgtggccagttgtacgaacgtctgcatacgcgtgacatgcgtatgatgggcggcctgtggggcaagatgaagtggttgcctgcgctgtccatgttctttgcggtggcgacgctcggtatgccgggcaccggtaactttgtcggcgaatttatgattctgttcggcagctatcaggtggtgccgatgattaccgttatctcgacctttgggctggtattcgcctctgtatactcgctggcgatgctgcatcgcgcttactttggtaaagcgaagagccagattgccagccaggaactgctagggatgtcgctgcgcgagctgtttatcattctgttgctggtggtgcttctggtactgcttggcttctatccgcagccgattctggatacctcgcattctgcgatgagcaacatccagcagtggtttgttaattccgttactactacaaggccgtaaatcgccatgacaataactccacaacacctgattgcgctgctaccgctgctgatcgtcggcttgacggtggtggttgtgatgctctccattgcgtggcgacgcaatcacttcctcaatgccacgctgtcggtcattgggcttaacgctgctctggtttcgctttggtttgtcggccaggccggggcaatggacgtcacgccgctgatgcgcgttgacggctttgcgatgctctacaccgggctggtgctgctggcgagcctcgccacctgtacttttgcctacccgtggctggaaggctataacgataaccaggaagagttctacctgctggtgttaatcgccagcctggggggaattctgctggcgaacgccaaccatctggcggcgctgttcctcggtattgaactgatctcactgccgctgttcggcctgattggttatgctttccgccagaaacgctcgctggaagccagtatcaaatacaccatcctctccgccgccgcctcgtctttcctgctgttcgggatggcgctggtctatgcgcagtccggcaacctgtctttcgaagcgctcggtaagagcctcggcgatggtatgctgcacgagccgttgctgctggcgggctttggcctgatgattgtcggtctgggctttaaactctctctggtgccgttccacctgtggacgccagacgtttaccagggcgcgcctgcgccggtttctaccttcctggcgacggcgagcaaaatcgctatcttcggcgtggtaatgcgtctgttcctgtatgcgccggtaggcgacagcgaagcggtacgcgtggtgctgggcattatcgcctttgcctctatcatcttcggtaacctgatggcgctgagccagaccaacatcaaacgtctgctcggttactcttctatctctcacctcggctatctgctggtggcgctgattgccctgcagagcggcgagatgtcgatggaagcggtaggcgtttatctggccggttatctgttcagcagcctcggcgcgtttggcgtggtcagcctgatgtccagcccgttccgcggcccggatgccgactccctgtactcttaccgtggtctgttctggcaccgtccggttcttgccgcggtgatgacggtgatgatgctgtcgctggcaggtatcccaatgacgctgggctttatcggcaaattctacgtgctggcggtcggcgttcaggccagcctgtggtggctggtcgccgccgtggtggtgggttccgcgattggtttgtactactacctgcgcgttgcggtgagtctctacctgcacgcgccgcagcaaccgggacgcgacgcgccgacaaactggcagtacagcgcaggcggtatcgtggtgctgatctccgcgttgctggtgttggtactgggcgtctggccgcagccgctgattagccttgtgcagttagcgacgccgttgatgtaagcaataagtaaaaacgaaaaacccgcttcacgaagcgggttttttattacctgatgtcattctttaaaatgactcaggacggtagaccggataaggcgtttgcgccgccatccggcctgtaaggtctcagcgaccggaatttaacttagcaactgccggcttaccagcgggccgctgatgttttgcgccgcgcgttccatcacttcctgtatcactgaagagagttcgttaatctcaaacttggccacgtagccgtcggctttcaccttacgcacatgatcttcgttggcgctgccggaaagggaagagtgaataacaaccgggatctttttcagccgttcatcggttttaattttacgcgttaacgtaaagccatccatctccggcatctcaaggtctgtcaggactagcgcgattttctcgctaattggcttaccttcggcctccgcttcctgcgccagttgctggattctctcccaggcatccttgccggtcacatgcatctgatgcggaatttccatcgcgttcagccctttttccagcatcgcgcaggcgactttggagtcttccgccacaatggcaaccgcgccgggggtaatataaaatttattggtcttcagattggtggcgcgcagatcgtggctggaggggacaatatcataaaggatctgctcaacgtcgagcaccagcgccaggttgttggtttctttgttgtcatccaggcaggcaatactggtgatgtagcgaccgttgacggctttctcggcggtatgcacctgttgccagtcaagacgcataatattttccaccgactcgacggcaaatgcctgtacgctgcgcacatattcggtgatcagcaaaatattcagcccggtttccggcttgcagcccgctaccgctggcaaatcaatcaccggaatgacctgatcccgaatattgaccatgcccaatagcggcgctttcatgcctgccgggcgcgtaaaggcgggcataggtatgatttcgcgcagcttaaatacattgataccgaacagctctgacttctgttcatgcagcgatgtaccaagacggaataacagcagttcaaaacggttggacagggttaaattggccctgtcatcaatatctttctgaaaattgtccatcctaacctcattatgaaagcctgccttttttagtgttatcggcaatgaggacaaaaaatggagcgctaaaccgggaaaacagaaaaatcgtaagccagctccgtcgccgggaaaatagcgcggcattccgccagtaagcgctgacagcctttatcgtcatagcgtgagctaatgtgggtcatgatcagccgaccaacggcagcctcccgcgccagcgtcgcggtttgacgggtggagctgtgtccgcgagcgttggctttctcctccattgacgcatccagcgtggtttcatgaaccatcacatccacaccctgcgccagtgcgagggcggcctcgcagggcgcggtatcgccgaaaatcgccactgatttcccggccacggcgggagcaaggtagtcggcgccattgatctgccttccatcggcaagcgtgacggtttttcctgccttcaacgcctgaaacagcgggccgggcgtaacgcctgcggcttttaacgccctggcattcagcgcgccaggcttgtcatgttcaacaacgcgatatccgtagcactccagtggatgctccagcctgaatgcggtcactttacgcagaccgtcgtcaagaatatcgccagcgctaatttcttcaatttgcaacggaaaatcggtccatgaaccgctaaggcgcagtgtggttgcaataaactcacgcacgccttgaggcccgtatacggttagcggatggggattccccgccatcgaccggctgcatagcagacccggcaggccaaacagatgatcgccgtgaagatggctgataaaaatgcgctcaagcttaccgggatgaaacgcggtattaagcatttgatgctgtgtcccttcgccgcaatcaaaaagccatactcccggctgcgttggatgttgcagatgtaataaaattgccgttacattgcgtgagcgtgtgggaacgcctgcggacgtacctaaaaaaattaattccatcttgtccatacgcgtttggttatcgtttaacccaagattaccacaacacaggagcgcatcatgattgactggcaggatctccaccatagcgaacttactgttcctcaactttacgcgttactcaaattgcgctgcgcggtctttgtggtagaacagcgctgtccttacctggatgtggatggcgatgatttagtcggcgacaatcggcatattctgggctggcatcaggatgagctggtggcgtatgcgaggattctgaaaagtgataacgaatcagacccggttgtcattggccgggtgatcgtcagcgatgcctggcgaggggcgaaactgggccagcaattaatggcgaaaacgctggaatcttgtgggcggcactggccggataagccgctatatctgggggcgcaggcgcatctgcaacctttttatgcgcggtttggttttattcccgtcaccgatgtttatgacgaagacggcattccgcaccggggaatggcgcgggaggttcatcaggcataaaccgaaaccgttgactatagttaggagcaggtgttaacacaacggagaatgagaatgtcatatcaatttggtgaatcacgtgttgatgatgatctgactttgctcagcgaaacgctggaagaggttttacgttcctcaggcgatcccgccgatcaaaaatacattgagctgaaagcccgcgcggaacaagcgctggaagaggtgaaaaaccgcgtaagccatgcgtcggatagctattattaccgggcaaagcaggccgtttataaagcggatgactacgttcatgaaaaaccctggcagggtattggcgtaggcgcggcggtaggactggtgcttggactgctgctggcgcggcgctaaatccccccactgaacagaattgcaaccctccctaaatgaggtactgcttttttagggcagtaccccgtataatgtggggtttttaacagggaggggccgcgtgcattctattactactgcgctggaaaatctgacgcgtcagctatcgcaagagataccggcgacgccagggctttgcgttttcgatgcgcctttccctttaaacgatgccttcgatgcattgagctggctggccagccagtcatcctttccgcaattctactggcaacagcgcaatggcgacgaagaagctgccgttctcggggccatcaccgtcttttcatcgctcgatctggcgcaacggtttttacgtcagcacgcgcagcctgacctgcgtatttgggggctgaatgcgttcgagccgaaagagggctacttattgctgccgaggctggagtggcgacgtagcggtggtacggcgaccttacgcttacatctgcacagtgacgtttcgctacgcgatgatgcgcgcctggcgaaagcgtttctcgcttctctggtcggtattaagcctgttccggcgctgcgcctttcgctcacgagcgaacaacactggccggacaaagacggttgggtgaagctgattcagcaggccacccacactattgcgcaagaggcgtttgataaagttgtgctggcgcgggccaccgacttacaattctcccgtccggtcaatgccgccgcgatgatggcgtccagtcgtcgtttaaatctcaactgctaccacttttttatggccttttccgccgataccgcctttctgggatcatcgccggagcggctctggcggcgtcgtgaaacggcgctgcgtaccgaagcgctggccgggacggtggcgaaccatccggataaccataaagcctggcagcttggcgaatggttaatgaaagacgataaaaaccagcgagaaaatatgctggttgtcgaagacatctgccagcgactgcaaaactgcacccactcgctggatgtgctgccgccgcaggtgctcagactgcgcaaggtacagcatttgcgccgctgtatctggacggcgcttaatcaggcggacgacacgctctgcctgcaccagttacagcctaccgcagcggtcgccgggatccctcgtgaacccgcgcgttgttttatagaacaacatgagccgttcgaacgtgaatggtatgccgggtcggcaggctatctctccacgcggcaaagtgagttttgcgtgacgttacgttcagccaaagtgacggccaatgtggtgcggttgtatgccggcgcgggaatcgtccgcggctccgatccggaacaggaatggcaggaaatagataataaagcggccgggttacgtaccttattgcagatggacgcgtaatgagtcacatattcccgacccatatcaataatccatttttgcagctctttatacttagtcccaatgattgataccggacaaactcatgtcagtaagtgcatttaaccggcgctgggcggcggtcatcctggaagccttaacccgtcatggcgtcaggcatgtttgtatcgctcctggttcccgttccacgccgctcacgttggcggcggcagagaatcctgcttttattcaccatacgcactttgatgagcgtgggcttggtcatttggcgttagggctggcgaaagtcagccaacagccggttgccgttattgtcacttcaggtaccgccgtggcgaacctctatccggcgctgattgaggcgggtctgacgggcgagaagctcattttacttaccgccgatcgcccgccggagttgattgactgcggcgccaaccaggcgatccgtcaggcggggatgtttgcctcgcacccctcccaaactctgtcgttgccgcgtcccacgcaggatattccggcgcgctggctggtgtcgaccatcgacaatgcgctcgccatgcttcatgcgggcgcgctgcacattaactgtccttttgccgaaccgctgtatggcgatatgaatgacaccggtctggtctggcagcagcgtctcggcgactggtggcaggatgaaaaaccctggctgcgcgaagcgcgtcgactggcaagcgacaaacagcgcgactggttcttctggcgacaaaaacgcggtgtcgttgtcgccgggcgtatgagcgcggaagaaggcaaaaaagtggcgcagtgggcgcaaactctgggatggccattaattggcgacgtattgtcgcaaaccgggcagccgctgccgtgcgccgacctgtggctcggcaacgccaaagcggtgaccgaactgcagcaggcgcagattgtcgtccagcttggcagtagccttaccggaaaacgcttactgcaatggcaggcaacctgcgtgccggaagagtactgggtaatcgacaatattgaaggtcgtctggacccggcgcaccatcgtggacgcagactggtagcgaaaatcgccgattggctggaactgcatccggcggaaaaacgtaaaccgtggtgtgtagagatcccgcgtctggcggaactggcgtggcaacgggtggtcgcgcagcgagacacctttggcgaagcgcagctggcgcaccgtatccgcgactatctgccggagcaggggcaattgttcgtgggcaatagtctggtggtgcgtctgatcgacgcgctgtcacagttgccggccggctatccggtatacagcaatcgcggggcgagcggcattgacggcctgcttttcacagcggcgggcgtgcagcgcgccagcgccaaatcgacgttggctatcgtcggtgatttatccgcgctgtacgatcttaacgcgctggcgttactacgtcaggtatccgcgccgtttgtgttgattgtggtcaacaataacggcgggcagatcttttccctgctgccgacgccgcaaagtaagcgtgagcgcttttatctgatgccgcaaaacgtccattttgaccatgcggccgccatgtttaacctgcgctatcatcgcccggaaaactgggaagaactggagtctgcgctggctggcgcgtggcgaaccccggcgacaacggtgattgagctggtggtaaacgatacggatggcgcgcagacgctgcagcaacttttggctcaggtaagccatctatgatgttgcacgcgcagcacatgcccggacagcctgggacgccctcgctggttttcctgcacggtttttctggcgattgccgcgaatggcagccggttggcgaacagtttcacggctgttcgcggctttatattgacttaccaggacatggcggatctgcggctattccggtcggcggctttgccgatgtcatcagattactgcgcgccacgttaattagttacaacatactaaagttttggttggtgggatactcccttggcggccgtgtggcgatgatggcagcctgccagggaatacccggcctgtgcggcctggtggtcgaaggcggtcatccggggctgcaaaatgaacaggcgcgcgctgaaagacgattgtccgacgggcgctgggcagagcgttttcgtcatgaacccttgactgaggtttttcacgactggtatcagcagccggtgttcgcctcgctgacggcgcagcaaaggcaggcgctaacggcgctgcgtagccagaataacggcgaaacgctggctgcgatgctggaggcgacatcgcttgccgtccagccggatttacgcgaggtgcttaacgcgctggcatttccgttttattatttatgtggcgaacgcgacagcaaattccgcgccctggcgcaggaagtggcggcgacatgccatgtcattcgtaacgccggacacaacgcgcaccgggaaaaccccgctggcgtggtagacagtctggctcagattctgcgtctctgactaaaggacacactatgatctatcctgatgaaacaatgctttacgcaccggtagaatggcacgactgctcggagggttacaccgacattcgttatgaaaaatccaccgacggtattgcaaaaatcaccattaatcgtccgcaggtgcgcaatgcatttcgtccgttgaccgtcaaagagatgattcaggcgctggcggatgcccgttacgacgacaacgtgggcgtgattattctgaccggcgaaggcgataaagcgttttgcgcgggcggcgaccagaaggtgcgcggcgattacggcggttatcaggatgactccggcgtgcatcacctgaatgtgctggacttccagcgccagattcgcacctgtccaaaaccggttgtcgcgatggtcgcgggttactccatcggcggtggtcatgtgctgcacatgatgtgcgacctgaccatcgcggccgaaaacgccatcttcggccagaccggtccgaaagtcggctcctttgacggcggctggggcgcttcgtatatggcgcgtatcgttggtcagaagaaagcgcgtgaaatctggttcctgtgccgccagtacgatgcgcaacaggcgctggatatggggctggttaacaccgtcgttccgctggcggatctggaaaaagagaccgtgcgctggtgccgcgaaatgttgcaaaacagtccgatggcgctgcgttgcctgaaagcggcgctgaatgctgattgtgacggtcaggccgggctgcaggagctggccggcaacgctaccatgctgttctacatgacggaagaagggcaggaaggccgtaacgcctttaaccagaagcgtcagcctgatttcagcaaattcaaacggaacccataatgcgtagcgcgcaggtataccgctggcagatccccatggacgcgggggtggttctgcgcgacaggcggttaaaaactcgcgacgggctgtatgtttgtctgcgtgacggcgagcgtgaagggtggggagagatctccccgctgccgggcttcagtcaggaaacgtgggaagaggcgcagacggcgctcctgacatgggtgaatgactggcttcaggggagcgagggattaccggagatgccttcggtcgcgtttggcgcaagctgcgcgctggcggaactgactggcgtcttgccggaggcggcggactatcgcgccgcgccgttatgcactggcgatcctgacgatttggtactgcggcttgccgatatgcccggcgagaaaatcgctaaggtcaaagtgggtctctatgaagcggtacgcgacggcatggtggttaatttgctgctggaggcgatcccggatctgcatctgcgtctggatgcgaatcgcgcctggacgccgctaaaagcccaacagttcgcaaagtatgttaatccggattaccgcgctcgtatcgcctttctcgaagaaccgtgtaagacgcgggatgattcccgcgcctttgcccgtgaaaccggcatcgcgattgcctgggacgaaagtctgcgcgaagcggatttcacctttgaagccgaagagggcgtcagggctgtggttatcaaacctacgctgaccggatcgcttgataaagtgcgtgagcaagtcgctgccgcccatgcgttgggactgacggcggtcatcagctcttcgatcgagtccagcctcggcctgacgcaactggcgcggattgccgcctggttgacgccgggaacgctgcccggactggataccttgcatctgatgcaggcgcaacaggttcgcccctggcctggtaacgcgttgccttgtctgaagcgtgatgagctggaacgactgttatgacattcacggactggccgtggcgccactggcgtcaggttcgcagtcaggcgcccgctctgcgcctgaacgatgaagtgctaagctggcgcgccctctgtgagcgtattgatgcgctggcgggcgggtttgccgcgcagggcgtacgggagggcgacggtgtcctgctgcgcgccgggaatcagccgcgcactctgttggcatggcttgcgctgatgcagtgcggcgcgcgggttctgcccgtcaacccgcagttgccccagacgttgctggaggcgctggtgccgaagttaacgctgcgttttgcgctgacactggaaggcgaaaacgcgttttccggattaaccgtgttgcagttgcggaaaagtacagtggcgtatgctgtggcctggcaaccgcagcgtctggtttccatgacgctgacatcgggttccacaggattgccaaaagcggctgtacatacgtgccaggcgcatcttgccagcgcgcagggggtgctttcgctaatgccgtttggccctcaggatgactggctgctatcgctgccgctgtttcatgtatccgggcagggtattatgtggcgttggctcttcgccggggcgcgcatgacggtacgcgataagcaaccgctggagcagatgctggcaggttgtactcatgcttcgttggtgccgacgcagctgtggcggctgttggcgaatcgggcggcggtgacgctgaaagccgttttgctcggcggcgcggtgattccggttgaactcaccgaccaggccagcaaacaagggattcgctgctggtgcgggtatgggctcacggagttcgcgtctacggtatgcgccaaagaggccgatggttcggatgatgtgggcgcgccgctttccggcagagagatcagaatcgtcgataatgaagtctggctgcgcgccgccagtatggcggaaggttactggcgtgatggcaaactgatcccgctggttaatgacgaaggctggtttgccacgcgcgatcgcggcgagctgaaccacggtaggctaaccatcgccgggcggctggacaacttgttctttagcggcggcgaaggcattcagccggaggaagtcgaacgcgttattaacgcgcatccgctggtgcaacaagcctttgtcgtgccggtagaagataaagagtttggccatcgtcccgttgcggttgtggagtatgcatcgcaggccggagacgtgaacctcgctgaatgggttcgcgataagctggcgcgttttcaacagccggttcgctggttgacgctgccgtcagaactgaaaaacggagggattaaaatatctcgccgtgcgctccagcagtgggtgtgtaagatctgtaaaaattaatgttaggttaatatacaaccattccatcgctattgccgttttgtttatccgttgatgtgtaacgtgttatgaacaatcagcgtgaaacgggggcgctatggaatggttggttaagaaatcgcattatgtcaaaaagagggcgtgccatgttctggtgctgtgcgatagcggcggttcgctaaaaatgatcgccgaggcgaattccatgatattactgagtcccggcgatatcctgtcgcctttacaggatgcgcagtattgtattaatcgggaaaaacaccagaccttaaaaatcgttgatgcacgctgttattcctgcgacgaatggcagcggttgacgcgcaagccattatgatctggcgggcagaaaaatcagcattacccccgccataatgcacaatacgccgagcatcgcttttaggctgaaagcgccttgcaaaccgggtaacaacattgaggctacccagacaagcacataactgagactcagcagcgcataggctttgctgagcgcgagcatgtgtaatgttttctgccagcagaagacggaaaccagatatcccgccaaaccggcgaatagcgccagggtcgcggcattaaatgcgcccagcccggaaataaacgccagtggatgcgctatcgatggcagtcgcatcatggcgaatcctaaactcaactgggcgagggaggcaatcgcaacgcttatcagtccccacattacgcccattatgccgcactccccagaatgataatgccgctgataattaatgcgacgcccaaccagtggcggggcagaacctgttcatgccagattttccaggccgccagcgtgacccagacaaaattcagattcaacatcgggtaagcaattcccaccggcagggtttgtagcaccagcagccacagcaccatcgctgcacccatgcatatcagcgccaggcccagccacagcatcaagtgacggcggcgtccgctcgtcgtcaatggccgtgtcgcttgcttctggcagagctgaccgtcaacgctgagcagactggcaagcaccagaacgatgccgatcatttaggccgatactgaattaacaccagacgcccctgataatcaacattgtccgcagggggaagggaaagtgcgctgatgtcttcgtctttgtctattgaaagtactagcgtaataatgccctcctgacgatgttggttgagccaggcgttaaaatcgtcggctttaacgaatttattctgtacatcaggatagctaagaccatacctgagttcgcccgcgtgtccgtagagcataatatcgtctcgtttcagactccaggccagcccggcggcgacgcccacgctgtcggcaagaatatagcggcttgatgccaaaggcgcctgggtcatttcgacaaaaaactgtggctgtttggactccatcaccctgtcggggacggaaaagccgaacagcagcgccagtcccagcggacaaaacgcgggtaataggtattttgggctatgacagaggctataccagcccacaaacgcccaaacagtaaagacgccccagacgcaaaacactttataggtttcgatatgcgtccacaccggcgatttcagcgggccccatgaggagacgacaaacgccgcgacgatcccgattatcccgaacaccaggttgatcccgccgttgacacgtagcgcggcgacgccttcttttacgttatgcaggacgaagcgcgccatgagtatcgctatcggtgcgaaacaggaaagaacataggtgggcagtttccctttcgcaatgctgaaaaagagaagcggcatgatcgtccatccgagcaaatagaatgcgccgtttcgctcgcgccagcccagtttaagcgcgccaggcagtaaccccagccacggtaaacttcccgcgagcagcaccggcagatagtaccagaaaggggctttatgctgggcatcgctcatggcgaatcgctggatatgctccacccagaaaaagtaatgccagaaatcggcttcgcgtcgcgcaatggcgatcgcccagggaaggacaaccacaaagcagctcaagaccgccagccagccgtaaagcaaaaagtccttccagcgtttctgaacaataacccacggcagcacgctcaccaccggtacggccagggcgaggaaccctttagttaatacacccagaccgcaggttgcgcccagtagcaaaaacatcccaatcttgcccgttcgggtcgtggcctgcatcccctgccagaaacaacacatcccggccgtaagccaaagcgcgatcatcgggtcgagtaccgcatacgtcccgatactgtaaacggcaaagagggagagaaagatcacggaggcgagcaacgcggtacgtttatcccgccataagcggaacgtcagccacgccaccagcgctgcggccagcaatgtcgttaaaatagcgccggcccgcacgccaaaattggtagcgccaaaaagccactgacccagactgtttatccagtaaccggctatcggtttttcaaaataacgtaatcccagaaaatgcggcacgatccagtcgccagacgccagcatctcccgacttatttcggcatagcgcgtttcatccggctgccagagcaggcggctgttgacaggaataacatagtagagcgcgataaacgcggcgaaagccagataatagcgtatcgatttcatcatgaggcgctcactgcctgttgacaccccagccaaccttcacggccagggatgtgtccacgtacaatttgccccaacggcagagactcaggcgatgccggcagcagttcgcccagaggacaaaaggtgatccccgcatcgcgtgcacgaacgagcaaatcttcaaacagcggctgatggacaataccttcgacttccgcatggatggtatataccggcgtgcctttgtcctgcaacatacgggaaataatccaggtattgaacgactgcgcctgaacggcggggccgataacctcatcccacgtgggtaaggtgaccgggatttgcggcgtccctgtctggcccggcatcagtagcggacggaataaggtggttccacggcaatcgctgttatacctcaggttgaacggttctttcgcacgaacaacgcgcccatccgctcgccagccggccgcggctgagcaggtgacgggttttccgataatggcttcaagcgccgttatgccgcgcgcaatatcttcttcaagctggcggatactccagtggccgctgtgagtctgccacgcatggtgatcccaggcatgtagtcccgtctcatggtatgttgccgtttcacgaataatcccggcattagcgttgccgatattttttcccggccaggcggtgccggccagcaggatatcccaaccgtagagcgaggcggcgtttgaacgtagcattttccataaaaatcgcggttttatcagacgccaaagatggcgtcccatattgtccggcccgacgctgaagaaaaagctggcctgaacgccgtggcgatgcaatgtcgccagcagccggggaacaccttcacgcgttcctcgcaaggtatcaacgtcaatgcgtaaaccgactttcgtcatgatgcgcgttccgcgatatcgacgctacgcagaaagaagtccagcgttttttcaaccgtatcacgcatcgcaatagacggctcccagtccagacagcgcctggcattgtcgatactgggtttccggtgtgcgacatcctgataacccttgccgtaataactacggctttcgacgacctggaaaccggcaaatggtgggaaatggcagcgcagcggatgcttatcaaaactgtcgagcaacagcgtcgccagttcctgaatactggcttcgttgtcagggttgccgatattaatgattttgccatcgcaccgatcgccctcattcacaataatgcggaataatgcttcgatcccgtcacgaatatcggtgaaacagcgcttctgctgaccgccgtcgataagcttgatcggcgtcccttctaccaggttcagaatcaactgcgttatcgcgcgtgaactgccgatacgcgccgcgttcaggctatccagccgcggccccatccagttaaagggacggaaaagcgtgaagcgcaatccctctttttcgccataagcccaaatcacccggtcgagaagctgtttggaaacggagtaaatccagcgcggcttattcatcggcccgacgatcagattcgatttgtcttcgtcaaaagaggcgtccgtacacatgccgtacacttcagaggtagacgggaaaaccacgcgtttacggtatttcacgcaataacggataatccgcaggttttcttcaaaatcaagttcaaagacgcgcagcgggttgcgggtgtattcaatcggggttgcaattgctaccagcggcagtacgacatcgcattttttgacatgatattcgatccattctgagtggatgctgatatctccctccacgaaatgaaagcgagggtggagcaggaatcggctaatggcgttgctgccgatatccataccgtagacctcgtaattctcttcatccagtaaccgttcggtcaaatgattgccgataaaaccgttgacgccgaggatgagaacgcgaatgcgacgtttaccgctggtcgctggtggacggttcaaacacgcgcccgccaccagaccaagcgtctgtgcaagctgcgagccctgtacagtaatgccgtctccggcctggccggtaataatctccagcgcgccatcggcgcaggcgacccgcagcggagagaccgaaattaccgagccgggaagcgcgccttgcgcatccggacaaattcgggaagaccagatagtgaatttttgcgagccgttatagctgaacgcgccgggccagggggcggctaccgcccgcaccaggttatgcaccgtggaaaccggtttgtgccagtcgataaggccatcttccggcctgcggcgaccataatacgtagcgtcagactcacgctgaggaacagaaggtatattgccgcatttcatggtgggcaggatgctattaagtaactggcgcgcggcctgacatagcttatgatgcagggtaagcgcaacatcgtcctgcgcaatagcgacgcgttgactggcgacaatctctccggcgtcggcacgtttgaccatacgatgcagcgttacgcccgtttcgctttcgccgttaaccagaacccagtttagcggcgcacggccacgataggctggcaatagagaaccgtgcagattgaacgcgccagccggggcgaggtgcagaatttcttcgcttaacaggttgcggtaatagaacgaaaaaataatatctggcgcaagttcagcgatgcggtcgacccagataggatggtttacgttatccggcgcataaaccggaatccctaatcctgccgccagccgggagacggagccaaaaaaggtgttttccgcaagattgtcggcatgagtgaaaattgcggcaatctcatatcctgcatccagtacggcctgcacgccctgacatcccatatcgtgataggcaaaaataacggctttcattggtgactttcctcagtaaacgacgtgctttccgggtagataacttgttgaacaaaatagcgggggcgggcgcggacatcgttataaatgcgaccgatgtattcgcccagcagtcccataccgatgaattgcgcgccgatgaaggtaaacagaacggcaaagagcataaatacgccttccgccgcccactgcggtcccagtgccaggcgaagtacaataagcaataccgacaggctaaacccgccgatggcgataacactgcccagcagactcaacaggcgcagaggcgtcgtcgtcaggcaggtcaccaggtcatacatcaggttaatgagacgcataaaactgtatttagagtcgccaaattcacgttcagcgtgatgcaccgggatttcggtagcccgacgagcgaaaatgttggccagaatagggataaaggtgctgcgttcatggcagcgcaacatggtatcgataatagggcggcgataggcgcgtaacatgcagccgtaatcgcccatcgctttgcccgttgtgcgctggatcagcagattaatgatttttgacgccgatttgcgaaacaggctgtcctgtcggttctgtcgcacggtgcctaccacatcgaatccttcatcggctttcgccaccaggcgcgggatctcttccggcgggttttgcagatcggcatccagcgtaatgatgagatcgccgcttacatggctaaaccccgccataatcgctgcatgttgaccgtagttacggttgagtaaaatagagatgatatggctatcggcctcctgggacgccttaaccatcagctccgccgagctatcgctgctaccatcatctatcaataaaatctcccacgctttgcccagactctcgcaggcggtggtggtgcgtcttatcaattccggcaggctttcctgttcgttatagacaggaataaccaccgagactttttttatgggggcggcgtcaaacatgcttattgtcctgctatctgatgaagggcggtaatgacccgatcaaagtcactctcggtcatgtccgggaagagcggcagtgagcagatccgctcgctgttccactcggtgtcaggcagcgtgagcgttgggaaacgttcgcgataatatttttgcgtatgcgcggcgcggaaatgcagccctgtgccgatgcctttcgttttcagcgatgccatcagagcatcccgggtaataccgcagcgggcttcatcgacccggataatgaataaatgccaggcgtgaatatgctcccacggcggaaggctcagaggctgaaaaggaaggtctgccattgcctgatggtactgcgctgcgatggcggcgcggcgagcgttaagcgcatccagtttctgtaactgggcaagcgcgatagcggcgttgaagtcgggcaaattatatttgtagcccggcgccaggacttccgcttgtggcgcgcgtcctccgctctgtcgatcccaggcatcaacgccaagcccgtgaaacttgagactgcgcagtttatcggcgaattgcgggttatccgtgacgacgataccgccttcagcgcaggtaatgttcttaatggcgtggaaggagaaaatcgcggtgccccgggcgccaatgtggcgacctttgtagctggttcctgtcgcgtgcgccgcgtcttcaatcaccggaatgccataacgcgcgccaagagcgtaaatagcgtccagatcggcgggcgcgccagcgtagtggacggggataattgctttggtttgtggcgtaatcgcggcttcgatatgttcaggcgtgaccatcagcgtatcgcgatcgacatcgaccatgacgggggtcgcgccgagtaaaacgatcatatttagcgtagaaacccacgtcattgacggtgtaatgacctcgtcgccttcaccaatacccagcgccatcaacgcgatgtgcataccggcagtggctgaactgacggcaacggcatattgattgcctgttagccgacaaaacgccgcttccagttcctgatttttcgggccggttgttatccaacctgagtccagtacggtcttaacggcagcgagctcttccgcgcccatcgccggacgggagaaaggcaaaaagtccgacatcatttttccttcagccattgaaagccgcttttcaaatatttcggcaatagaaaagggcttattttttaacgcatttagctgaaccctactggatgaagattaaattaacattaagaaattaaggtgaagtaaaaagataattttaacggaattatgctttgctttcgccgaaagtttaaggcattttatgcatgcccaaaagctgtttttatgtttctggtcttccgtcgcggaatttcattttaatcgtattgctattaagttagctgcactgtctgcctgagaggttaatgtgctggcatttaccctacgctttattaaaaacaaacgctatttcgcgattctggcgggggcgttggttattatcgctgggttggcctcacaacatgcctggagcggtaacggtctaccgcagattaacggtaaggcgctggcggcgctggcgaagcagcatccggtagtcgtgttattccgccatgccgagcggtgcgatcgttccgataatacctgcctgtcagacagcacggggattacggtcaacggtgcgcaagatgccagagcgctgggtaaagccttcagtgccgatatacaaaattacaatctctattccagtaatacggtgcgcaccatccagtcggcaacctggttttccgcaggcaggtcgcttacggcggataaaaaaatgatggattgcggcagcggtatttatgcttcaatcaatacgttactgaaaaagtcgcagaataaaaatatagtcatttttacccataatcattgtttgacgtatattgcaaaaaataagcgcggcgtgaagtttgatccggactatcttaatgcgctcgttatgtatgcggaaaacggaaaactctttttagacggtgaatttgttcccggctagccgcatgttaaaagcgtaaagacagcctgaagcggctgtcgttattataataaccctttcaatgctaatgtgtggcgtgtcgctacattcaaatcatacagcgccagttcttctggcttgacccaggcgtagtcctgaaattcgtcgttaatacatatatcgcggttagcggaaacacagtcgaagatgagataaatcatataaatctcttcttgtctgccatcagcgtacgttttaacgcggatatcgtcgcgaaaggtccacggcgtaatatcgctcagaatcagttgttcgccgagttcctcccgaatctcccgacgcagcgcctcttcaatacgttcgcctggctcgaccccgccgcccgacagcgcccactgaccgggaaagacgccgcggttgtcggccattttgcacagcagataacagccatcattttgaattaatgggcaaactatagttcgttgacgcataagtcgcttccttaaaccaccaggccatcagcttaacaaatcattctgcgaaattctttgtgaaaaatggaagcgataacgcagactgcgttttttgttaattttgttgatgcaggcgtcgccatgtgatggcgcaatgatgcgtcacggcgaaagtagtatttcgttacaatatgtttttggaatggtttcttagtgcattgattcctcagcgtctggcagtacaattctgccgttttggggagtttttctttatgtgcttgctggaaagggtaaaaatgaaaaaaagcatattattaggttttgccggaatgctgttcgtttctgcatcggcgcaggccatcagtattagcggccaggcgggcgaagattacaccaacattggcgtgggttttggtacggaatcgacgggactggcgctaagcggcaactggatgcacaacgatgatgatggcgacgctgcgggcgtgggtctggggctgaacattccggtgggaccgctgctggcgacggtaggcggtaaaggtatttataccaatccgaaagacagcgatgaaggctatgcggcggctgtcggcggtgggttacaatggaaaatcggcaacagcttccgtctgttcggcgagtattattattcaccagattcgctgtccagcggtatcgaaagttatgaagaagcgaatgcaggcgcgcgtttcaccattatgcgcccgctgagcattgaagccggttatcgttacctgaacctggcgggtaaagacggcaaccgcgacaatgcgattgctgacggcccttatgttggcgtaaacgccagtttttgatgctaacggcgcggcaatcgtcgcgccatattcctccttttcccgtcattcttctttccacgtcatattcgtctttgcgttatagtgttttcatcataaaagcaggagaacacaatgctaaatgtggaaatgctatccaccggggatgaggtgttgcacggacaaatcgttgacaccaatgccgcctggctggctgattttttctttcatcagggcgttccgttatcacggcgaaatacggtaggcgataatctggacagtctggtcgctatcttgcgtgaacgcagtcaacatgctgatgttttgattgttaatggcgggttagggccgaccagcgatgatttaagcgcgctcgccgcggcaacggcaaaaggcgaaggattagtactgcaccaggcgtggctgaccgaaatggaacgttactttcagcagcgtggtcgcgtgatggcgccgagcaaccgtaaacaggcggaactgcctgccagcgcggagtttattaataatccggtcggcactgcctgtggatttgcgctacagctcaaccgctgcctgatgtttttcacccccggcgtaccgtcggaatttaaggttatggtggagaaggaaatcttaccgcggttacgcgcgcgtttttcgctgccggagccgccgctttgcctgcggttaacgacttttggacgttcagaaagtgacctcgcgcagcgtctcgattcactgccgttgccgcccggcgtgacgatggggtatcgctcatcaatgccgatcattgaactgaaattgaccggcccggcgacgcaacgggaggcgatgctggcgttatggccagaggtcaaacgggtcgccggacagaacctgatttttgaaggtacggaaaatctgccggcgcaaatagcccgccgcctgcaggaaaggcagttgagtctgacgttgagcgagcaatacaccagcggtttactggcgctacagctttcccgtgccggggcgccggttcttgccagcgaagtcgttccttctcaggaagagacgctggcgcaaacggcacactggacgacagaacggcgcagcaatcattatgccggtctggcgctggccgtgtcggggctggaaaacgaacatcttaatttcgcgctggcgacgccggatggcacgtatgccttacgcgtgcgttttagcgccaatcggtatagtctggcaatacgtcaggaggtctgcgcgatgatggcgctaaatatgctgcgccgttggcttaatggcgaggacattaccagcgagcatggctggatagacgtggttgaatcattgacattataatccctttctcttatctgcgatgggaacgacatcgtgagccggataaggccgctatgccattatccggcaatattatctgcttttttgtccagccaattgtactgaatacaaagtaatacgtgcgttaattcacatttatatggttaacccttccactccgttggaaggcggataagctttgacgcgcttcacaattttttccctactgacctttcacactgattccagtgtctcagactggagtccaatatgttggaatcaagtaaagtcccggctcttactcgcgcaatcgacatcctcaatttgatcgcgcgtattggcccatgcagcgcggcaatcattattgaaacgttgcgtattccaaaaagcaccgcgtacctgctgttgaatgaattaaaacgtcagcgatttattagcctcgatcatcaggagaactactgcctgtggactaagctcgttgaattgtcgggtcatgcgctcagcaagatggatctgagggagctggcgcgtcctcgtctaacacaactgatggatgaaatcgggctgctgtgtcacttggggatcatcgaccacgaaaatgcgtattacatactgaaagtggaatcctcatccactatcagcgtgcgctcgcatgaggggaaaagcctctctctttatcgttccggcatcggcaaatgcctgctggcatggcagccggccgccgtacgcaaagccattattgaaaaaatggtatgggagcgagccacgctgaccaccatcaccgagccgcaacaattgaatgatgagctggaacgcattcgccagcgtggatggagctttgataacggggaggattatccggatgtccgctgcgttgccgcaccggtatttaatgccagaaacgaactgaccgcggcaatttcactggtcggcacgcgcctgcaaatcaacgaagagaatcttgattatttggccggtaaagctattgcctgtgccaaagatatttcacgcctgttgggatggaaaagtcccttcgactcactcgcatcttaaaatggagaatattatgactcttcctaaaattaaacacgttcgagcctggtttattgggggcgctaccgcagagaaaggggctggcggcggggattatcacgaccagggaggaaatcactggattgatgaccatatcgccactcccatgagcaaatatcgcgactatgagcagtctcgtcagtcttttgggatcaacgtgttagggacgctgattgtcgaagtagaggcggaaaatgggcagacggggttcgccgtttcgacagcaggggagatgggctgttttatcgtagaaaaacatcttaaccggtttattgaaggcaaatgcgtaagcgatatcaaacttattcacgatcagatgctcggcgcgaccatgtactactccggttccggcggtctggtgatgaacacgatttcctgtgtggatctggcgctgtgggatctgtttggcaaggtggttgggctgccggtttataaattgctgggcggagcggtacgcgatgaaattcagttttacgccaccggcgcacgcccggatctggctaaagaaatgggctttatcggcggtaaaatgccgactcactggggaccgcacgatggtgatgcggggatccgtaaagatgccgcgatggtggcggatatgcgtgaaaagtgcgggccggatttctggctgatgctcgactgctggatgagtcaggatgtgaactatgcgactaaactggctcacgcctgtgcgccatttaatctcaaatggattgaagagtgtctgccgccgcagcagtatgaaggctatcgcgaattaaaacgcaacgcgcctgcagggatgatggttaccagcggcgaacaccatggtacgctgcaatccttccgcactctggcagaaaccggcattgatattatgcagccggatgttggctggtgcggcggattaaccacgctggttgagatcgccgcgcttgccaaatcgcgcgggcaactggtggtgccgcacggttcgtctgtctattcgcaccatgcagttattactttcactaatacccctttcagcgagttcctgatgaccagcccggactgctccaccctgcgtccgcaatttgacccgattctcctggatgagccggtgccggtgaatggacgcatccataaatcagtgctggataagccgggcttcggcgtcgagcttaaccgtgactgtcacttgaaacgcccttatagccactaataactcgtgcgttgcctttgtacggcaacgccctcatcctgttgaggatattgctatgagcatcactttacttgacggcgtagtgaagaaaaaccgcgcacgtttaattccttttatgttggcgctgtacgtactggcgtttctggatcgttcaaatattggttttgccaaagagacctatcagatagataccgggctaagtaatgaagcctacgcgctaggggccggtattttctttgtggtttacgctttccttggcgtaccggctaacctgctgatgcgcaaatttggcgcaagaacctggatcggcacgactaccctgctgtggggctttctctctgctgcgatggcctgggcggatagtgaagcaaaatttctgataatccgcacgctattgggcgcggcggaggctggatttttccccggcatgatctatctaacttcacaatggttcccgcagcgtaaccgtgccagcattatggggctattttatatgggcgcgccgctggcgttaacgttgggttcgccgctctccggcgctctgctggagatgcatggttttatggggcacccgggatggttctggatgttcgttatcgaaggcctactggcgattggcgcagggatattcacctttttctggcttgatgacactccgcagcaggcgcgttttcttagcctggaagaaaagaacgcgcttatcaggcaactggcgagcgaagaagagaaaaaggtcacgtcaaggcttgcggatgcgctgcgtaatggacgcgtctggcaactggctattatttatctgacgattcaggtggcggtatacggactcatctttttcctgccgacccaggttgccgcgctattgggcactaaagtgggctttaccgcttcggtggtaacagcggttccctgggtggcggctttgcttggcacatggcttattcctcgctactccgaccgtaccggcgatcgccgtaacgttgcggcagtgacgctactggctgcgggcattggcattggcctgtcaggtctggtttctccggtgctcgctattctggcgctctgtgttgcagcagtaggatttattgccgttcagcccgtattctggaccatgccaacgcagctactttccggtacggctctggcggcaggaattggtttcgttaatctgtttggcgctgtgggcggttttattgccccaattctgcgcgtaaaagcggaaacgttgtttgccagcgatgcggcgggcctgctgacgctggccggagtcgccatcattggctcattaattatcttcacgctgagcgttaatcgtccggtggcgcaatccggcgctgcgcatcattaatcttatctacgttgtaaggatcgctatgaacgcattgttatcaaatccttttaaagaaggattacgtaaaagggatacgcaaattggtttgtggctcagttcaaccacctcttatatggcggagattgcggcgacgtcgggttatgactggttgttaatagatggcgagcacgcgcctaatacggtgcaggacttgtatcatcagttacaggccatcgccccatacgccagccagccggtgattcgcccgatcgagggaagtaaagcgctcattaaacaggtactggacatcggggcgcaaacgctactgatcccgatggttgacaccgcagaacaggcgcgccaggtcgtttccgctacccgatacccgccgttggggcaacgaggcgttggcgcgagcgtggcgcgtgcggcgcgctgggggagaatcgacaactatatggcacaggccaatgagtcgctctgcctgttggtgcaggttgaaagcaaagtggcgctggaaaaccttgacgcgattctggaggttgaaggcattgatggcgtctttatcggtccggcagatctctctgcttcattgggttaccccgataatgccggacacccggaagtgcagcgaatcattgaatcgtgtatttatcgtattcgcgccgccggaaaagcggcgggttttttggcggtcgatccggcaatggcgcagaaatgtctggcgtggggcgcgaattttgtcgcggtcggggtagatacgatgctctacaccgaggcgctggacagcaggttggcgatgtttaaatctgttcagtcagtaagcacggcaaaacgtagttattgagaaaaatgccggatggcacgtatgccttacgcgtacgttttagcgccaatcggtatagcctggcaatacgtcaggaggtctgcgcgatgatggcgctaaatatgctgcgccgctggcttaatggcgaggacattaccagcgagcatggctggatagacgtggttgaatcattgacggcatagaacttttagtgggaaggcttggccttcccatccttatatacttataaattcttggcagagcatcatttcaggataagtactcgccattactggagactgtattcatatatttgtcgccgggtttgggtgttaaatagtgtttgttcctctactgaaagcgttaagaaattttccgcaaattctcgtagtgtggtagcaggatcgttttgtcctgcattcgataagagttgaattgtatggtaacaaaatagaccacagccgttgggtacattattttgtaaattggtttcaataaaatcaatatcttcgttttctgatatgcctgcaatttttgctgcttctataatctcttgcttagtattttcatttaaatcatgataagtattaaatataaggcattttattttttctgcaagtttataaaataaacagataagccagtgatctcctgtatttatcagaaagacttcattttcagataatcctgattgagccatcttttcaagtagctgagtgcgtaatatattttctttggtggtaggatgaataagcccaataggatagtttaccgagagaagaggtgattcttgaaccagacctagcgttgcggctgctagctcatctgacgacaacattcgcgcactacaccaaagattttcaactcctacctgttcttgatctgtttgagcgaactggtcgcccataattttatgtgctattcctatttttttagaaaggtcggttgtcgcggaaccggccatataaagtaatctggaaggggcatgtagctttttccactcagtattatcttttgttatatcgttattggcgatttgatgtaatacaaggcaagcctgattgatttttttgtctatgtctggtgatcccgatctttttccgctaaagagatcaaaaagaaatttctcaactctatgtcccaggttatcattgcgtaacgcaagattgcataacagatcaatacaattctgatcaccgttctctacggcgctaaacaacaacgcaagcgcctcatcgctcacctcttctgaatataaactgtgaaattgcggtgtgctcaatcggtaaagtgaatttacacatatattcattttgctctgtttcctggtaggtgaaagtaacgaatatgatgtcatgtataattatttgtaaaaatattattgttagtgggagatatattaaatcaggcatagacctgattttattattattcacataacactcaattattattggagatattcagttatccccctctttaaaggaggctggtaacgcggcgatacaagagatattgctctataaacagtaacgtcgttatctgtcatgccaccgtgggttagcggtcatggttaaccaaatagggcaggttattgcaaagagacatccgcgtttatacccaaaataatccgtagccaacacataagcaacttgaagtatgaagggtatatgtctgatggaaaatcggccctggtgagtagagtaatggcgccggaggggctccggcgctttttacttagcccagcgctttcgccagtagcgtaatggggtattcgcagcgtttgcttgtagacatctcaatttgccacttacaggtttcacaatcggtgacgacaatgtcggcgccgctctcttcaatctggcggaacagcggcgcgccgatggactgtgatgtcggatagttttcctttttaaatccatacgtaccggcaatgccgcagcactgtgaatcaagtaccgtcaattcaagccccggaatttgtcgcaacagttcaagcgtgtaaagcgtccagcccattttttccatatgacacggcgtatggtagaccactttcagcggcaaaggattaagcggcagcgttttcccggcatccagtttgcgccatagccagcgggtggccagctcgatatgttcgcgcagcccggcgttgtccacgtccagcacttcaggatattcatcgcgcaacgcaaacgtacaggtggatgacgtggcgatgaccggaatacctttgacggcaatcgcctctcgtagcgactccacattgctgatagcctgtttgcgagctttatccgtaaaaccgttagcgatcagcggtacgccgcaacacttctctttactcagtaactgtacgccagtacccattgcgttcagcaccttaatcagatcttttccgagctgcggatggttgtaattcacaaaacagccatggaaaaaggcgacctgatctttgtatttagcctgctgcgccgccacgctacgataccagcggcggaaggtgccgaaagagtattttggtaaggtgcggcgatgatcgattttgagcgcgtaatcaagcaactggcgcactggctttaatgcggtggcggtattgaccaccggcgcgaacggcgttgaaacgctgcccatcagatcggtatggctgagaataaagttacgcaatgacgggcgcgtcgtatcgtatttcgcgcgggcgcgctggatgatatcgccaatcttcacgtccgacggacaggcgacctcacaccgtttgcagttaatgcaatatttcagcgcctcatcatacagcgcgccgtctttcagacgcaggcgttcgccatccggtccggcctgtttagggccagggtagccaggattaacgcggctgaccgggcacgcggtggtgcacaccgtacatttaatacaactttcaaaacgtgtgtcgctcattgctgttctcctgcacgctcagcgatatggtgcgcggcctggagggcgctgactgcgcagacgccgccgccgcatccctcagctataggatcgaatcccgccagcacagaacctattgcatacagattttctaccgtgttgcccgcaagggaggggcggaaagcgtcatccgtcacgacgccaaactgctgccagggctgtgggtcgaagaaatgttgttgataccattcggcgcgggtggccgtttgctgtacgtcgagccctaaaataggttcgcggatcccttcgcgctcggcaaccagcccgctactaaagaagctaccgctggcaagtacggcaaaacgcgggcgcagtgggatatcggcatggttgcgggtccatatttcgctcacggtaccgcgacggcaggtgactttcttcacttcatcgcccggcatccagatgccgccctgacggacaaactggcgctggagttgattgtgcagacgaataccgagcaccgatggcggcagcgtcggcagcagcgtgagcgcgcagggcagacgttcgttaagccagcgccacagcgtatcgttcgccagcccgaaacaggcgggcatgatgatcatgtcgcagtttgtcgctattggcgacagcgcgtcgtatagcagctgccatttttcttcgttatcaagcagacgcgcgatattgaccgcgcgaaattccgtcgggttatcacgcagtacgtccagttccggaaggtcgatttctgcggtttcaacgttgaggtcgcgttggcgcagcgacgctgccgcaaggtgcgcctggaaatccagtaatccgctaacgccgacgacgcaaattcgctgtgcggataacggccagaccggtacttccggcgagctaagccaggtagaacgcaatgtgccaagcggcgtgacacgctggtgcgcctgctgtacgtcgccgtataactgcgcgccgctggcgttaagtagcgtttgcgcctgttgcgccagcgtaaggactttttgcgcgcctaaacgcgaataaggatgttcaggcgcctggcggcgcagcgcatcaagcccggcggtaatgtcggtcaccggttggccgttgggcagggcgctaagtagatccagcgagccggaggaaaaatgcagcgcgctttgtccgcgggtgacgatggcgcagcgtaatccatgctgctggagttgcagtccgcatagcaaaccggcgagaccgccgcccataataaccgtatcaaatttcatcctggtgctccttctccagaccgcataatccctgataaacccagcgcgtgaattcgctttcgcgcagcgcgtctccccaggcgacaggttgtacgcctttccagcgctcattcagaaattcagagagttgcgtaatagattgcgccgcggtcgtcacattaaaacgctgcaatagcccggccgcgcggcaggcgcacagttcgccctggcaagtgcccatccctacgcgggtgcgacggcgcagatccagcaggctattcacggttaagttttcgacggcatactgcacttcccccgccgtgacggcctcgcattcacagaccaggctacggtgttggcggccttcactcagccaccccggcgtgcgatcgccatgccgataaaccgccgatccgcgtagcggcgcgggaagcgagataatgcgtttcagcgtatgttccgtagactcttttgagccaggcaacggcgtatccgccgtgatgcaggggcgagtattgcccaacttgcggcacacggcgtcggtcgcccattccgccatcaggcgataagtcattagcttcccgccggtaatggtaatgaagccatcaagcccgtcgcgttcggcgtggtcgaacaacacaataccgcggctgacgttacgaccgctgggatcgtcatcgctggccaccagcgggcggacgccggaatacgcgcgcagaatacgtgtcttcgccatgacaggggccagtttttccccttcacgcagcaggatatcgacttcatctgcggtgacgcggttgctgtctatctcattgtaatcaatatgggtagaggtggtgccgatcagtgaaatcgtatcgccaggtaccagaatgtcggcatccgatggtttccggcagcggttaatgacatgctggttgatccgatggtccatgatcaacagcgagcctttcgccgggaacatgcgaatactcaggtcggcgtattcggcgatccgttgcccccagataccagccgcattgaccaccaccggcgcgtgaagcgtctgggtttcgccagtgagatggttacgcacatggacgccgcagaccgttgcgccttcacgaatgagcccggtcacttcatgcgccgttaacacgattgcgccatgttctctggcatccagcatattggcggcggtcaggcggaaagggtctacggtgccatccggcacttttaccgcaccgatgagcgcagggttaacggaaggttcgatgatgcgagcctgctgcggatcgatggcttcagcgcgaatgcctgccgcttcacaggcgcgaataaaggtggcctgaaacgcaagaccatcttccggcaacgtaataaacagaccatccgtcggttcgacgcaatggcgggcgatccgttttaaaatctggttttcactaatgcactcgcgcgcggattccgcgtcggtaaccgcataacgagcgccgctgtgcagcagcccgtggttacgcccggtcgcgccggtcgctatatcatgccgctccaccagaatgacacgtaaaccgcgcagcgcgcagtcgcgggcgatccctgcgcctgttgctccaccgccaatgataatcacgtcacttgcttgcgagtcgcgagttttcattgtttttccttacagttcgttttttatcatttagccatacaaatcatatggaatgtttgatttcgcgcgcctttctgaacattagtcataaaactgtaacaatatgtgctgtaattcacattaacgtgacgtatctttacttaacatcgcggccacactgggagcagcggggttgtttgaacgaactgcggtgtttacctctaaataaaatacgggctacggaggctacaatatgttgagtatttttaaaccagcgcttcataaagcgcgcttgccagcggcggagattgatccgacctatcgccgattacgctggcagattttcctggggatattctttggctatgccgcgtattatctggtgcgcaagaactttgccctcgcgatgccctacctggtagaacagggtttttcacgcggcgatctgggctttgcgctgtccgggatttctatcgcttatggtttttcgaaatttataatgggttcggtgtccgatcgctcgaatccgcgcgtttttctgccggcagggttgattctggccgcagcagtcatgttgtttatgggctttgtgccgtgggcgacatccagcatcgccgtgatgtttgtgctgttgttcctttgcggctggttccaggggatggggtggccgtcgtgcggacgtacgatggttcactggtggtcgcagaaagagcgcggcggcattgtgtcggtctggaactgtgcgcataacgtcggcggcgggatcccgccactgctgttcctgctggggatggcgtggtttaacgactggaaagcggcgctctatatgccagcctttggcgcgattgtggtggcactgttcgctttcgcaatgatgcgcgatacgccgcaatcctgcggtctgccgcctatcgaagagtataaaaacgactatccggatgactacaacgaaaaagcggaagaagagctgactgcgaagcagatcttcatgcagtacgtactgccgaacaaattactgtggtatatcgctatcgccaacgtgttcgtctacctgctgcgctacggtatcctcgactggtcaccgacctacctgaaagaagtgaagcatttcgcactcgataaatcctcctgggcctacttcctctatgaatacgcgggtattccaggcacgctgctgtgtggctggatgtcggataaagtcttccgcggcaaccgtggcgcgtcgggcgtattctttatgaccctggtcactatcgcgaccatcgtttactggatgaacccggcaggcaacccgaacgttgatatggcttgtatgattatcatcggcttcctgatctacggcccggtaatgttgatcggtctgcacgcgctggagctggcgccgaaaaaagcggcgggtacggcggcgggctttaccggtctgtttggttacctgggcggttctgtcgctgcaagcgccattgtgggttataccgttgacttcttcggttgggatggcggctttatggtgatgattggcggtagcattctggcggtaatcctgctggtggtcgtgatgattggcgaaaaacgccatcatgatgagctgcagttaaaacgcaacggaggctaataacatgaaaaccacactgaaaaaccttagcgtggcgttgatgttggcaggaatgaccatcggaagcggcgccgtggcggctgaaaaagtcgtcatcgcccaccgtggcgccagcggttatctgccggagcatacgctaccggcgaaagcgatggcgtatgcgcaaggggcagattatctggaacaggatttagtgatgacaaaggacgaccatctggtcgtcctccatgaccactaccttgaccgggtgactgacgtcgctgatcgttttccggaccgggcgcgtaaagatgggcgctattacgctatcgattttacgctggatgaaattaaatccctgaagtttaccgaagggtttgatattgaaaacggcaaaaaagtacaaacttatccgggccgtttcccgatgggaaaatctgatttccgcattcatacctttgaagaggaaattgaattcgttcagggattaaatcactctaccggtaaaaatatcggtatttatccggaaattaaagcaccgtggttccatcatcaggaagggaaagatattgccgcgaaaacgctggaagtgctgaagaagtatggttacatcggcaagcaggacaatgtctatttgcagtgttttgatgtcgctgagctgaaacgtattaagaatgaactggaacccaaaatggggatggatctcaatctggttcaacttattgcgtataccgactggaatgaaacccagcagaaacagccggacggtcgttgggtaaattacaactacgactggatgtttaagccgggcgctatgaagcaggtggcggaatatgcggacggtattggtccggattaccacatgttggtcgcggaaggttcgacgaaagggaatatcaagctgactggaatggtgcaggacgcgcatcagaataagatggtagtgcatccttacactgtgcgtgccgatcaattgccggactatgccacagacgtcaatcagttatacgatatcctgtataacaaggcgggcgtcgacgggctgttcaccgacttcccggataaggcggtcatgtttctgcaaaaaaatgactaaaggtatgccatagtagaagtgaagcgccggatgaggacataaacgcctcatccggcctggcgcaacgtttgccagcgtaagtctgataaacgcaatgtcatcaggcggtgttgttttatagcaaaccctcatcggtcagtgtttccatacatttttgtaataaaaatagcgggcttccttctaccggcggttcttttgctaacagtgaaatttgtcgataaaaggtgggttccagcgccacggagcataattttcctgtcgtggcttttaaggttaattctggcaataaggcgatacctaatccctggcgaataaaattcagcgcagtatcgggatggttaaattcatatttaaatatcggttcaatacccttttctttaaacaacgccataatacttaattcataacgacctttactgacaataagtggttcgtccatcagttcttcgaccgttactgtactattggccgccaggggatgattttcaggcaccactacggtgaatttatcccggtaaatggggacgcaatacataccgttgaccggaaaaggaacgaaaccggcatcaatacttccgtcctgcagcgaatcaataatagccgtactgttctcttcataggggataatttttacatttggatgatggctttcaaaatagcgaatgacgccgggtaaaatgcaggcgcaggcgctgggaaaacagccaatccgtagcgtacgggccgggttctttttttcttgttcgacaatctcttttaccgcgttgacgtcgcgctggatcgcgcgtaagtgcctgacgatgcggctaccggcggcggtaagctcgatctctttacgacgctcacgaatcaatatgtcaacgccgagctcctcctcaagcgcggagatggcctggctgacggcggattgcgtcatgtatagccgtttgctggcctcggtaaatccgccgtactccagtacggcaagcagggcatggatttgggttagcgtcattagtaaaacctaatcaatataattaaaacgattaatttttctaataaagtgcacttgtttatactgcgattctatcgaatacatcacattttgacgcacctgataggtgttcagttgagctgagcgttgcctgcgtgcgccatctgaatgggtcgttaagaatgaaagaaaaattatggacgaaggatttttgggcaatcaccatagtaagttttattatcttttttgttttttatgtactgctaactttattacccatttatatcgctgaccgcctgcatgcttctgcagataaggcaggattgctagtgacatgtttcctggccgcggcaattgttattcggccgtttgccgggcagtgggtgggaaaatattcgaataaaaagattctggtgctctcttctttggcttttttggtgattaccgcgctgtatccagtttgccattctatcgagtcgctgctctttatccgcgtacttcatgggattacgtttggtgttattaccacggtaaaaggaactatttcagcgcggttaattccggcctcccgacgtggagagggcatcagctttttctctttagcgatgggcctggcgatggtcgtaggaccgtggattggtttgaatatggcccgctgggacgcgttcactgccgcattctggctttgttccgctgtagcggcgttagagattgtgctttccctgattgtgacggttcctccggtaattcgtcatgccgatggttcgaaaccgaatctgggtttttccgcgatgtttgaccgcgccgccttgccttttgcgctggtcaccttttttatgactttctcctatgccggcgtgtcggctttcctggcgctgtatgctcgtgagctggatttaatggcggcggccagtaatttcctgctgtgctacgcgattttactgatgatatgccgtaccttcaccgggaatatttgtgataaaaaagggccgaaatatgttgtttatccatgtctgttggcttttaccatcggtctggtggcgctgggctacaccaatggcagcatcatgatgattatttccggcggtctcatcggtatcggctacggttcggtcacgccggttttccagacgcaaattatcagctcggttgaaccgcataaaatcggtgtggcgaattcactgttctttaacgcgatggacgccggaatggcgattggcgcctttatcatgggaatgatggttgagtcggttggctatcgtatgatttatgtcgctggcgcggtgctggtggtactcgctggcgcactgtatgccgtgcagatgaaaaaacgtggcgtgatgccgttggtttccaccagcgagttgcactgagttacatctcgatttcgatatcgccttttgccctgcagcagcagggcaaaatctctcccggctggataaacgctaaaggttccgtaatccagtcaacctgaccggcaaccagccgggtacgacaggagccgcaatatccttcgcggcactgatactccacctcaacgttatgcgattccagcgcggccagcagagaagggtgttcatcctggcacagcagctgtgtgccagtgatacgcagcgtgacgcgtcccatcagagctggaaattactcagatcgtcggtatcgacttccgaatcgatttgtccgaccagataagaactaacttccacttcctgtggcgcaacctgaacgttatcggacaccagccaggtattgatccacgggattgggttggagcgggtctggaacggcagatccagacccactgcctgcatacgaatattcgtaatatattcaacgtattgacacaggatatctttattcaggccgatcatcgaaccgtcgcggaacagatagtccgcccactctttttcctgctgcgccgcctgcacgaacaggtcatagcattcctgtttacactcttcggcgatttccgccatctccgggtcgtccacgccgctacgcaacaggttcagcatatgttgcgtgccggtcagatgcagcgcttcgtcacgggcgatcagacggataattttggcgttgccttccatcagttcacgctcggcaaatgcgaaagagcaggcgaagctgacgtagaagcggatggcttccagcgcgttcacgctcatcaggcatagatacagttttttcttcagctcacgcagattcacgacaaccgttttgccattaacggtatgggtgccttcaccgagcagatgccagtaactggtcatctcaataagttcgtcgtagtaggcggagataccttcggcgcgcttctgaatttgctcattggtcacgatatcgtcaaacacgaccgccggatcgttgacgatgttacgaataatgtgggtgtaggatcgtgagtgaatcgtctcagaaaacgcccaggtctctacccacgtctccagctccgggatggaaatgagcggcagcagggcgacgttcgggctacgtccctgaatggaatccagcagcgtctggtatttgaggttgctgatgaagatatgtttttcgtgctccggcaacgcctgatagtcgatacgatcgcgggagacgtcgacctcttccggacgccagaagaaagagagctgtttttcgatcagtttttcgaagatgtcatatttctgctggtcatagcgtgcaacgttgaccggctggccaaagaacatgggttccttgagctgatcgtttttcgtttgtgaaaaagtggtgtatgccattgaagtgaatcctttatgggatgagcgccggatggcggcgcaaacgccttatccggcctacaaaccgtacaatcgtaggccgggtaagcatagcgctacccggcactattcatcagatcttacaagcgccgctttcgcagccatcgtcctgaatagaaggcgccaaatcgtcctgcgcatcttccgcgccgtcgcgggtattttgatagtacagagttttcacgccaaacttatacgcggtgagcaaatctttcagcagttgctgcatcggcacttttcctgacgggaaacgtgacggatcgtagttggtattagcggaaatcgactggtcgataaacttctgcatgatacccaccagttgcagataaccgtcgttgttcggcatctcccacaacagttcgtaagcgtctttcagatgctcataatccggcacgacctgacgcaaaataccgtctttcgaggccttgatgctgacgtagccgcgcggtggttcgataccgttggtggcgttggagatctgggatgacgtttccgacggcattagcgccgatagcgtggagttacgcagaccgtgggttttgatcgactcacgcagctgttcccagtcgtagtgcagcggttcgttgacgatcgcatccagatcttttttgtaggtgtcgatcggcaaaatgccttttgcataggtggtttcgttgaaccatgggcaggcgccttgctctttcgccagttcgttggacgctttaagcagatagtactgaatggcttcgaaggttttatgcgtcagattattggcgctgccgtcggaataacgtttaccgtttttcgccagccagtaggcgaagttaatcacgccaatgcccagcgtacgacggcccattgcgccgcgtttggcagccggaatcgggtaatcctgataatcgagcagagcatccaaagcgcgtactgccagaatagccagttcttccagctcgtccagagtcttaatggcacccaggttgaaggcagacagcgtacacaacgcaatttcgccgttttcatcgttgacatcgttcagcggtttggttggcagggcaatctccagacacaggttagactggcgtaccggggcgacaaccggatcgaacggactgtgagtattgcagtggtcaacgttctggatatagatacgaccggtagaggcgcgttcctgcatcatcagcgagaacagttcgaccgctttcacacgctgtttgcggatgctgtcgtcgttttcatacttcacgtacaggcgttcgaattcgtcctggtcggcgaagaatgcatcgtatagcccgggtacatcggacggactgaacagcgtaatgtcgccgcccttcagcaggcgggtgtacatcagtttgttgatctgtatgccgtagtccatgtgacgtacgcggttgccttccacgccacggttgtttttcagcaccagcaggctttccacttccagatgccacatcgggtagaacagtgtcgccgcgccgccgcgcacgccgccctgcgagcaggatttcaccgccgtctggaagtgcttgtagaacggaatacagccggtgtggaacgtctcgccgccacgaatcgggctacccagcgcacgaatgcggccagcgttgatgccgataccggcgcgctgggaaacgtatttcacaatcgcgctggaggtggcgttgatggaatccagactgtcgccacactcgatcagtacgcaggagctgaactgacgggtcggggtacgcacgccggacatgatgggcgtcggcagcgagattttgaacgtagagaccgcatcgtaaaaacgttttacatagtcaagacgcgtttcacgcggatagttagagaacaggcaggccactaccagaatgtagaggaactgcgcgctttcatagatttcgccggtcacgcggttttgcaccagatatttcccttccagctgcttaacggcagcgtaggagaaggtcatatcgcgatcgtgaacgataaacgaatccatctgcttgaactcttcttccgtgtagtcttccagcagatgattgtcgtatttgccaagctcaaccatttttaccacatggtggtaaagtgcgggcggctcaaactggccgaaggctttcttacgcaggtggaaaatcgccagacgcgcagccaggtattgataatccggcgcatcgcgagagatcaggtctgcggcggccttaatgatagtttcatggatatcggaggtcttaatcccatcataaaactgaatatgcgagcgtagctcgacctgagaaaccgatacgttattcagtccttctgccgcccaatcaagcacgcgatgaattttgtcgagattgatgcgctcagtacggccgtcacgctttgtcaccagcagactctgattcatgtagttttctacctgtttacctgtccgtgaaagaaaaatatcccccccgcttatccacaacgccacgttgtgactaactctgtggataaatactatatatagggggtaatcgataagtgaaacgctatatggtgagtattctagtagggattcttttgagtacaagagttgattttggcgttaaattgcggttgtaaaagagtaagaatcgctaaatgcgcgtctgataaggcctggagaggatgtcaacaattcataaaaaaatcaaaatttgatcgaatgctgattttttcatcgaagagaaaggttgcgcccgatgatctaacgcaacccttataggaaaattctttgatgtcaggcttttttagcgcgggtatgcaacatgtagttaacgtctactccgggaccgagtttgaaagtattggttatcgggttgtagtgcagcccggtgatatgttgctctttcaggacggtttcatctacccagcttaacagttcagcaggcttaatgaatttcttcacgtcgtgcgtgccttttggcaccatgcgcagaatatactcagcgccgacgaccgccatcagccaggatttcccattgcggttcaacgttgagaagaacacctcgccgccgggtttaaccagttgggcgcaggcgtggacgaccgattgcggatcgggaacgtgctccagcatttccatacaggtgacgacgtcgtattgctgggcgtgttttgccgcatgttcctcaaccgtctcctgcacgtactctacctcaatgccgctttccagcgcatgcagtttggcgacctgcaaaggctcaaagcccatatccagcccggtaacggtagcgccttcgcgcgccatgctctccgccagaataccgccgccacagccgacgtcgagcacctttttaccgaacaggccgcctgagcgctcagtaatgtagccaaggcgtagggggttgatgcgatgcaatggcttgaattcgcccttcagatcccaccagcgcgacgcgacggcttcgaatttggcgatttcattatggtcaacgttgtgagctaccgacggtttttcagtgttcatgagtacatgagattccgctattgatctatcggggcagtatagcaggtgcaaagtcgctgcgttatatctactgccgtctttattacgctttcagcgcaagaagttttcttgcgcgttctgtaaaaccgctaccgatgtggtgcgtgataaaattacagacgccctcgacgttgttgttttttaacatatctaaaatagtggcatgtccacggttagagctggtgatatattcagcggtaaaatccagtctgtagcgaattgccaataaacgtgcagagatcaacaggtgtgcttgtgaaatgtatttattatcggcatatttcacaaaaacataatgaaaatcatgatccagtttgaggtaagcttgcgtatctcgctctgcattaatttttgctgacttcgataaaatattgcttaattcgactatgacattgttagcatttttctccatcgcttcacgaattgcgccctgttcaaggataaccctcattttgatgagatcattgatatcctcgtcggtgacagaaaaaacaaatgtcccactgcggggaatgatgttgaccaggttttcattatagctcagccaaataaaagcttcacgaattggtgttttacttatcatcagaatatttgatagttcattttcactgatcgcttgcccaagatcgaaatcgccatggataatcatctcccttattttctctttaatcacctgggtgatggatttgggtatttcaattgatatgtgactaaaatcacgctttaatctatttttcattttcttctcctccatggttaaacccggctccattgtaattaatttattcaaaattaacggatctaatatatcagatataagaaaatttacatactttattgttgttattgtatatttcattaagtttgcttgctgatatatcagatatgacacattagcttttgaattgtattgttttttacgtaacatcgattccggtcaatacccttattcattgaatcataaaaggtgatgcaaaatgagtagtccacaagaaaatttatacgatgcaattcgtattgtaaaaaggaaaatcattcctttggcctttattctttacttttttaactatatggatcgtgtcaatattgggtttgctgcattacgcatgaatgaatctctcggtattacgcctgaggatttcgctaatatttcttctatattcttcatatcatatttaatctttcaaattccgagtagcattggcttgcaaaagcttggcgcaagaaaatgaattagttccattattatcggctggggagcggtaacagggctgattttttttgctaaagatactcaacatattttgctggctcgcatttttttgggggtatttgaagctggctttttcccgggcatggtttattatcttgcatgttggttcccggctcgtgaacgcggaaaagtcaatagtttcttcatgttatctattgctgttgcatcggtattggctgcaccgatgtctggttggatcatcgagcatttgaataccccggattatgaaggctggcgctggctttttgctattgaaggtatccctaccgtattccttggcatcctgacattttatttactgcctgacagtccagaaaaggctaaatggcttacgccacagcagatatcggccttagttaataaattacgcactgacaatgaaaccgcagctgcattaaataaaaataccaactcatcctttctttccgtaatcaaaaatccagttttgcttcagctttctttcgcctacatgttgattcaggcggctgctctggcggcaaactactggttgccggggttggtgaagggattttcagctgattttacggatactgacgttggtttaatcatgagtattccgtttattttcgctatgttcagcatgccctggtggggctggcattccgataaaaagaatgaacgaaaatggcatgctgcattacccatgtttctggcaggctgtggttttctgatgattgctcttgtcccctcaatgtcgctgagaatgctggggctaacgttctatggtgttgggatcctcagctattacggaccttactgggcgctgccttctgcattattgtcgccgtcagggttggctatcagcattgcgtttattaactcatgtttaagtcttggcggattcctgattaataagtcactgggattcgtttctactcattatggtgcgacaggaatatttattgtagaggcaatactttgcttcgctgcggtagccgttttggcgttaatgaaaattgatgtgaaaaaagaaaaaagccaacaaacaaatgttgtatcacgaacctgataaatggagaaattatgaaaattacgtctattgaagtttttgactgtgaattaaaaaaaagagatcaaacgatgtcatcctataatccagtacttatccgggtgaataccgactcaggattaagtggtattggcgaagtaggactggcctatggcgcaggcgctaaagctggcgtagggatcatcagagatctggcgtcattgattgtgggtgaagatccattaaatatcgaaaaaatttgggagttctttttcagaaagactttttggggaatgggaggcgggaacgttttttatgccggaatgagcgctattgatattgctctttgggatatcaaaggtaaatatttaggtgtacctgtttatcagctccttggcgggaaaactaatgaaaaattaagaacctatgctagtcagttacaatttggttggggggataaacgccagatattagtgacacctgaggaatatgctgaggcggcgcgtgcggctcttgacgatggatatgatgcgattaaagtggatccactcgaaatcgatcgtaatggcgatgactgtgtttttcagaatagaaatcgtaactattcaggattgttactggccgatcaattaaaaatgggggaagcgcgaattgccgctatgcgtgaagcaatgggggatgatgctgatattatcgtagaaatccattctcttctcggtacaaactcagctattcaatttgcgaaggcgatagaaaagtatcgtatctttctttatgaagaaccgagccatccattaaattctgataatatgcagaaagtttcccgttcaacaacgattccaatcgccactggcgagcgttcctacacaagatggggatacagggaattactggagaaacagtctattgccgtagcgcaacctgatttgtgtctctgcggcggaattaccgaaggaaagaaaatctgtgactatgctaatatttatgacaccactgtacaggtgcatgtttgcggcggtcctgtttccacggtagccgcgctgcatatggaaacggcaattcccaactttattattcatgaacatcataccaatgcgatgaaagcatctattcgggaactttgtacccacgattatcagccggaaaatggctattatgtcgcgccggaacagcccggattgggtcaggaattaaacgatgaggtagtgaaagaatacctggcctatgtgattaaatagcatctggtgatactgattatggtttatgcctcccggcatatcccctaaataattcgagttgcaggataaaatggttaaccgtcttgaacagcgcttgcgctaaccccgacggggcgaggcccagggatgggccgagtaacttgccgccaacgcacatgaaacttgaagtatgacgggtatacacgggaggtattgattttccagcctattcctggccaggcccagatctcctctgtgtcgcctctgaagctgatcgccgataaacgccgagaccacgcttataaatgaagagagcatgtggcacccgaataaagcattgtctggctgcattccgtttaccagtacgtgggcgaatgtgttataatttgcgacctttgaatccgggatacagtagagggatagcggttagatgagcgaccttgcgagagaaattacaccggtcaacattgaggaagagctgaagagctcctatctggattatgcgatgtctgtcattgttggccgtgcgctgccggatgtccgagatggcctgaagccggtacaccgtcgcgtactttacgccatgaacgtattgggcaatgactggaacaaagcctataaaaaatctgcccgtgtcgttggtgacgtaatcggtaaataccatccccacggcgattccgcagtgtatgacaccatcgttcgtatggcgcagccattctcgctgcgttacatgctggtggatggtcagggtaacttcggttctattgacggcgactccgcggcggcaatgcgttatacggagatccgtctggcgaaaatcgcccacggactgatggccgatctcgaaaaagagacggtggatttcgtggataactatgacggtacggaaaaaattccggacgtcatgccgaccaaaattccgaatctgctggtgaacggttcttccggtatcgcagtaggtatggcgacgaatatcccgccgcacaacctgacggaagtgattaacggctgcctggcgtatatcgacaacgaagacatcagcattgaagggctgatggaacatattccgggtccggacttcccgaccgccgcgatcatcaacggtcgtcgtggtatcgaagaagcctaccgtaccggtcgtggcaaagtgtacattcgcgcccgcgcggaagttgaagctgacgcgaaaacgggccgtgaaaccatcatcgtccatgaaattccctatcaggtgaacaaagcgcgcctgatcgagaaaatcgccgagctggtgaaagataaacgcgtggaaggcatcagcgcgctgcgtgacgaatccgacaaagacgggatgcgcatcgtgattgaagtgaaacgcgatgcggtgggcgaggtggtgcttaataatctctactcccagacccagctacaggtttccttcggtattaacatggtggcgctgcatcacggccagccgaagatcatgaacctgaaagatattatttcagcgttcgtgcgccaccgccgtgaagtggtgacgcgtcggactatttttgaactgcgtaaagcccgtgatcgtgcgcatatccttgaagctctggcgattgcgctggccaacatcgacccgattatcgaactgattcgccgcgcgccgacgccggcggaagcgaaagcggcgctgatttcgcgtccgtgggatctgggcaacgttgctgcgatgctggagcgcgccggtgacgacgccgcgcgtccggaatggctggagccagaatttggcgtgcgtgacggtcaatactacctgactgaacagcaggcgcaggcgattctggatctgcgtttgcagaaactgaccggcctggagcatgaaaaactgctcgacgaatacaaagagttgctggagcagatcgctgaactgctgcatattctgggcagcgccgatcgcctgatggaagtgatccgcgaagagatggagttaattcgcgatcagttcggcgatgagcgtcgtaccgaaatcaccgccaacagcgccgatattaatatcgaagatctgattagccaggaaaatgttgtcgtaaccttgtctcatcagggctatgtgaaatatcagccgttaaccgattacgaagcacagcgtcgtggcggtaaaggcaaatcagcagcacgtattaaagaagaagactttatcgaccgcctgctggtggccaacacccatgacaccatcctttgcttctccagccggggccgtctgtactggatgaaggtctatcagttgccggaagccagccgtggcgcgcgcggtcgtccgatcgttaacctgctgccgctggaagccaacgaacgtatcaccgcgattctgccggttcgtgagtacgaagaaggcgtcaacgtctttatggcgaccgccagcggtaccgtgaagaaaacggcgctgaccgaattcagccgtccgcgttccgccggtattatcgcggtaaacctcaacgacggcgacgagctgattggcgttgacctgacttctggttctgacgaagtcatgctgttctcggccgcgggtaaagtggtgcgcttcaaagaagacgccgtccgtgcgatggggcgtaccgcgaccggtgtgcgcggtattaagctggcgggagacgataaagtagtttctctgatcatcccacgcggcgaaggcgctattctgaccgtaacgcaaaacggctacgggaagcgtaccgcagcggacgagtacccgaccaagtctcgtgcgacgcagggcgttatctctatcaaagtgaccgagcgcaacggttccgttgtcggtgcggtacaggtagacgattgcgaccagatcatgatgatcacggatgccggtactctggtgcgtacccgagtgtctgagatcagcgtggtgggacgtaatacccagggcgttatccttatccgcacggcggaagatgaaaacgtagtgggtctgcaacgcgttgctgaaccggtagatgacgaagaactcgatgctatcgacggcagcgtgacggaaggggatgaggatatcgccccggaagcggaaagcgatgacgacgttgcggatgacgctgacgagtaatattattgctgtgcgagggccggatatccggccctttttcttgtctatggaaaacccccagctaggctgggggttccggaaagctttcagctttaagccagttattaaaaccccttttgatttgttaaaacatcttgcggtctggcaactgcaaaagttcaacaagaaatcaaaagggggtcccaatgggggacgaaaagagcttagcgcacacccgatggaactgtaaatatcacatagttttcgcgcccaaataccgaagacaagcgttctatggagagaagcgtagggcagtaggcagcatattaagaaaattgtgtgaatggaaaaacgtacgaattctggaagcggaatgttgtgcagatcatattcacatgcttctggagatcccgccgaagatgagtgtgtcgagtttcatgggatatctgaagggtaaaagtagtctgatgctttacgagcagtttggggatctaaaattcaaatacaggaacagggagttctggtgcagagggtactatgtcgatacggtgggtaagaatacggcgaagatacaggactacataaagcaccagcttgaagaggataaaatgggtgagcaattatcgatcccgtatccgggcagcctgtttacgggccgtaagtaacgaagtttgatgcaaatgtcagatcgtatgcgcctgttagggcgcggctggtaagagagccttacaggcgcatcagaaaaacctccggctatgccggaggatatttattttgccgttgcgggctacgtcatttaccgctaccttagtcacactctatttacatcctgaggcggagcttcgcccctttgaaataccttgcttcctttcgaactacgctgaaagtctcgcgctacttattcagagcgttagcgttactcatttggctcttaatcgcctttgtttcggtgttttacatcgtcaatgccctgcaccagcgggagtctgaaattcgtcaggagttcaaccttagctccgatcaggcgcagcgttttatccagcgcacgtcggatgtgatgaaagagctcaaatatatcgccgagaaccgtttaacggcggaaaacggcgtcatgtcgtcgcgtgcgcgtgatgacaaaatggtggtgccggattttgaaccgctattcgccgactcagactgtgcggcgatgggctccgcctggcgcggctcgctggagtcgctggcctggtttatgcgttactggcgcgacaacttttcagcggcgtatgatcttaaccgcgttttcctgattggcagcgataacctctgtatggcgaatttcggcctgcgtgaaatgcccgtggagcgcgatgatgcgttaaaagcgttacatgagcggattatgaaataccgcaacgcgccgcaggaagaaagtgggaataaccttttctggataagccagggcgcgcgtcagggcgtgggctacttttatgcgctgacgccggtgtatctggccaatcgtctgcaggcgctgctgggcgttgagcagtccatccgtatggaaaattttttcacgcccggcagtttgccgatgggcgtcactattattgatgagaacggccattcgctgatttcgttgaccggtcctgacggcattattaaagcggagccgcgctggatgcaggagcgttcctggtttggttatacgccaggttttcgcgaactggtactcaaaaaaagcctgccgccatcctcgctcagtattgtctattctgtgcctgtagatttagtcctggagcgtattcgtattcttatcctgaacgctatcctgctgaacgtgctggtgggcgcagggctgtttacgcttgcgcggatgtatgagcggcgaattttcattccggcggagagcgatgcccagcgtctggaagaacatgaacagttcaaccgtaaaatcgttgcctccgcgccggtggggatctgtattctgcgcactattgatggtgtcaatattctgagtaacgaactggcgcacacctacctgaacatgctcacgcatgaagacagacagcgcctgacgcaaatcatttgcggccagcaggtcaactttgttgatgtattgaccagcaataataccaatttgcaaattagcttcgtccattcccgctatcgtaatgaaaacgtcgcgatttgcgtgttggtagatgtgagtacgcgcgtcaaaatggaagagtcgctgcaagagatggcgcaggcggcggagcaggcaagccagtctaaatccatgttccttgcaacggtcagccatgaattgcgcacaccgctgtacggtatcatcggcaatctcgatctgctgcaaaccaaagagctgccaaaaggcgtggatcgtctggtcacggcgatgaataacttctccagtctgttgctgaaaattatcagcgacattctcgacttctcgaaaattgagtcggaacagctaaagattgagccgcgcgaattttcaccgcgagaggtgatgaaccatatcaccgccaattatctgccgctggtggtgcgtaagcaactcggcctgtattgttttattgagcctgacgtgccggtatcgctgaacggcgacccgatgcgtttacagcaggttatttcaaacctgttgagcaacgccattaagtttaccgatattggctgcatcgtgctgcatgtgcgctgtgatggggattatctcagcattcgcgtgcgggataccggggttggtattccggcaaaagaggtggttcgcctgttcgatcccttcttccaggtgggaaccggcgtacagcgtaactttcaggggaccggtctggggctggcgatttgcgaaaaattgatcagcatgatggacggcgatatttccgtcgattcggagccgggcatgggaagccagtttacgttgcgcatcccgctttatggcgcgcaataccctgtgaaaaagagcgtggaaggactcgccggaacctgctgttggctggcggtgcgcaatacttctttgtgccagtttattgagaccagtctggcgcgtagcggcgttcatacgcagcgttatgaagggcaagaacccgccgcagacgatattttgattgtcgatgacgcgctggagcatacctggcaggggagggcggcggtcgtcttttgccgccgtcatatcgggattccattggaaagagcgcctggcgagtgggtgcatagtgtggcgtcggtgcatgagttgcccgcgctgttggcgcgtatctatagtattgagctggatagtgaagcgctttccagcgcattgccgacgacggataaaaccgcagattcaaatgacgacatgatgattctggtcgttgacgatcatccgatcaatcgccgcttgctggccgatcaactgggatcgctggggtatcagtgtaagacagccaatgatggcgtggacgctctgaatgtgctgagtaaaaatgctatcgatattgttctgagcgatgtgaacatgccgaacatggacggctatcgcctgacgcagcgtatccgtcagcttgggctgacgctgccggtcgtcggcgtgacggcgaacgcgctggcggaagagaaacaacgttgcctggagtccggtatggatagctgtttgtcgaagcctgtgacgctggatgcgttgaaacagacgctggcggtgtatgccgagcgggtacgtaaaacgcgggcataaaaaatgccggatggcggcgtcgcctgtccggcctgtaaaagatgagtcgactggtaggcctgataagcgtagcgccatcaggctgggtaacataaaagcgatttattctttgtctgtcggactcagggtgacggaagagagatagttgagcagcgcgatatcattctctacgcccagtttcatcatcgccgatttcttctggctgctgatggtcttaatgctgcggttgagcttcttggcgatttcggtgaccaggaagccctcggcgaacaggcgtaatacttcgctctcttttggcgacaggcgcttatcgccgtaaccgcctgcgctgattttctccagcagacgagaaacgctttccggggtgaattttttgcctttttgcagcgcggccagcgccttaggcagatcggttggcgcaccctgtttgagtacgatcccttcaatatcaagatccaacacggcgctcaggatcgccggattgttgttcatggtcagaacgataatagacaggctcggaaaatgacgcttgatgtacttgatcaaggtgatcccatcgccgtatttatctcccggcatggagaggtcagtgatcaacacatgcgcatctaatttcggcaggttgttgatcaatgctgtggaatcttcaaattcgccgacaacattcacccactcgatttgttcaagtgatttgcgaataccgaacagtacaatcgggtggtcatcggcaataattatgttcatattgttcatgtattgggctactttgctacagcaagcttttgacgtaggcgtcaatgtcgctgatatatttttctatacctggagcatctttctcacgaatcagatgttccagcgttacacataactgcttgccgggtaccagattaagcatggcaaacacccctttcaggcggtgggccgtttgggccagcgcagcgaaatcgctggttgccgcctcagtatacaacctcttaacatcatccggtactgtgtctacaaatagcgcataatagccgctggcatgaagctcggcattttcatctccgccgagcggggaggcgggaatctcttcctgcgccagctgctcttcgataagttgtagtacagcttcctgcatagcattgctcatattaaagttgacgcgcaactgacccgggccaattttccgcacgcctgactcatcatcgcttaaaagcaagcccgaggcagtaagattagacggattatccgttaaaaagagatcatattcttgacttatctgcctttcatccggcgtgatgcaggtggcgccccagttttctaactgacgcagcacaatcgcgcgaacctcgttggacgtcacatcgaccatcacgctcacgtcgtccagcaggcgctcttcgacctgagtatgctgatcgtgaggaagcattttgacatgaacggtatagcgcgtgcccagcgtttctcgcgctttaatgttgagatgaccgcccagtttgcgcgccagttgattgcacagccagaaggtgagcggattcgctttgccgtaacggtcgccctgcgtttcattcatatacgggaaatgcagattatcaatctcgtttaacgttacgccttcgcccgtatccagaatacggaaagtcagacgctccgcgatagattcatcctgctcgacttcaagcgtaattttacccatagcggtcgtcgtgacggcatactgaatcaacagcagcaaaatccggcgcagggcgtcgcgatcgccccagcgttcatcgttgccgctaagatggttattaatcagcagttgcagccctttacgcttaatggcgggcagcacttccggcacgacttcgtcaataagatcctgcagggagaacagcgtggtttcgcttttccatgcgtcattttccagcatattcgccagttggatttcatcgatcatacgtactaatacatccgcctgatccgccagtttcaggctttccggcgtggtgactgccgcggcgttaaccgccagttggcgtacgggctctttaagcgtgttgctgatattttgcataaaggcggcgcggccctgctgattcttctcatacaaacgctgcgcctgtttaagcttcttattcaccagcacttcccggtcctgatcgcgaataataaagatctgcgtgcggggggcgatctggctgcgaaacagacggatctcatacagttcgttattaattgtcgcctgaatcacgccctgatgctgctccgccatgctggtaatattttgcaggttaagatgcggcaacagatgatcggcgattttattgctgatcacggtgcggttgccttcctgatcgtagaccagcagacccagcggcagcagagaaacgatctcttcattaatggcgcgtaagacgcgaagctcattattcgccgcgttgccggatgtcgattccgtcgaccgtcccggctgatgacggaacgtggcgtagccaaataacgccaacgccagcagcccgatgttcagcagtaaaggcagcaaaatattttgcaacgtatcaagcaaaagcgtaccgaacggtacctgccagatcaggcgcattccggtagagttaagcgctgaggagatctcaatttttgaaccgttaaagctaatcgtgacgctatctggcgcttccttttcactgcttcgccccgtcgtctgggttgcgtcaggctctatccgaaaactgtccagcggcattcccggcgggattaaatcattaatgggcagatcaaacgccaccacggttgccagatgtcctggctgattgaaggtcgtgcgcagcgtaaaatagtgaccgttttgccaggccagttttcgcaatgaggagaaactttcgcgctcatccagcgcattcgcctgctgcaacatctctgcccggcgggaatcgacgatattgccaatagtggactctttaaagccggaagagagatctttcaacggtagggtagagataagaatcaggctgttatcctgtccgttgaggtaatacattgaccacggcacgttttccgcgccccacagcgtatccagataagttgacatacgctgcgtcatttccagcgtggcgctgtcatgggaaccgaaaatcagcgcttcagttttacgtcgcggcttttcaagataatacacatcctgtttcagacgcgtttcctgaagtccttcacctgtcgatggcgtagtggtcgcggcgatgttgtcataaatttgccaggtaacataccgccaggtgtccacgcgtttatgaatagcgtgagtgatatcgacaatttgatagcttttgtctttcaaccaggcgttgacggcgctctgtaccataacgcccatcgttaccagcagcacaatgatcagcaataagaagaaacgggtaatgcttcccggtagaagggagaatcgggtagagaccgttgtgtcagactgactcatttatgtttacgacctgtaaaagcaacgctgaaggtgaagggcagtataaagggtaatgaatgaatttccagactcttacgtcatgccgggcaacttaacacgcgctccgtcggcgggacgggaaaagcgtacaaccttcgcaaaacggtacaaatataaagactacttataaatgtttagcactaaatatcaagaaattatttgctaatgtcttatgaacggtcgagcaggggagggtagtgaataaccgtgatagttttaggcaggtagcataaatcagccgggtgtgtctgaaaaagggtaaaaaaaccgaatgtgaagcatccggttgaaataggggtaaacagacattcagaagtgaatgacggtaataaataaagttaatgatgatagcggtcactattttagttgcgaatgaagattctgttttatcattcagtgctatgaatttcatcaatttaacccgttgattttaaaagtttcgtgaatatattttgtctatttgtgcttatttttacttgatttttgctttaaaaaagttccgtaaaattcatattttgaaacatctatatagataactgtaacatcttaaaagttttagtatcatattcgtgttggattattctgtatttttgcggagaatggacttgccgactggttaatgagggttaaccagtaagcagtggcataaaaaagcaataaaggcatataacagagggttaataacatgaaagttaaagtactgtccctcctggtaccagctctgctggtggcgggcgcagcgaatgcggctgaaatttataacaaagacggcaacaaattagacctgtttggtaaagttgatggcctgcactacttctctgacgacaaaggcagcgacggcgaccagacctacatgcgtatcggcttcaaaggcgaaacgcaggttaacgatcagctgaccggttatggccagtgggaatatcagattcagggcaaccagactgaaggcagcaacgactcctggacgcgtgtggcgtttgcgggtctgaaattcgctgacgcaggttccttcgattatggtcgtaactacggcgtaacctatgacgtgacctcctggaccgacgttctgccggagttcggcggcgacacctacggcgctgacaactttatgcagcagcgtggtaacggctatgctacctaccgtaacaccgacttcttcggtctggtggatggtctggacttcgcgttgcagtatcagggcaaaaacggcagcgtgagcggtgaaaacaccaacggtcgcagcctgctgaaccagaacggcgacggttacggcggatcgctgacttatgcaatcggcgaaggcttctctgtcggtggcgctatcaccacgtctaaacgtactgccgatcagaacaacaccgctaacgctcgcctgtatggtaacggcgatcgcgccacggtttacaccggcggcctgaaatacgatgcgaacaacatctatctggcagcgcagtattctcagacctataacgcaacccgttttggtacctctaacggcagcaacccgtccacctcttacggttttgccaacaaagcgcagaactttgaagtggttgctcagtaccagttcgactttggtctgcgtccgtctgtggcttacctgcagtctaaaggtaaggacatcagcaacggctacggcgccagctatggcgaccaggacatcgtaaaatacgttgatgtcggcgcgacttactacttcaacaaaaacatgtccacctatgttgattacaaaatcaacctgctggataaaaacgactttacccgcgatgcgggcatcaacaccgacgacatcgtagcgctgggtctggtttaccagttctaatcagcaaaagatgttgctaaagggcctgcgggcccttttttcatgccttattccggcgtacaaatacgacgttttgatatacgcttgcgtccattcgaatgaggataaacagcgatgaaaatgactttttgccgggccgtgtgtctggcagcggcttttttacttatgggctgcgatgaggctcccgaaacgacaacagcgtcacctgccgctcaggtgctggaaggtaaaacgatgggaaccctctggcgggtgagcgtggttggtatcgatgcgaaacgtgccgcagagttacagactaaaatccagactcagcttgatgctgatgattggttgctttctacctataaaaatgactccgcgctgatgcgttttaaccattcacgcagtcttgcgccctggccggtcagcgaagccatggcggatatcgtgacctcggcgctgcgtattggcgcgaagacggacggcgcgatggatatcaccgtgggcccgctggtcaatctgtgggggtttggaccggatcggcagccgctgcatatcccaacaccagcacaaatcgatgcggcaaaagcgaaaacaggcctgcaacatttgcaggttatcgacagggctggacatcagtttttgcaaaaagatctgccggatctttatgttgatctctccacggtcggggagggctatgcggcggatcatctggcgcgtctgatggagcaggagggcattgcgcgttatctggtctcggtgggcggcgcattaagcagtcgcgggatgaatgcgcaggggctgccgtggcgcgtcgcgattcagaagccgaccgaccgggaaaacgcggtgcaggcgattgtggatatcaacgggcatggcatcagcacctccggcagctaccgtaactattacgagctggatggcaagcgcgtatcgcacgttatcgatccgcaaacggggcgccccattgaacacaatctggtatcggttacggtcatcgcgccaacggcgctggaagcggacggctgggacaccggcctgatggtgctcggtacgcaaaaggcgcaagaggtcgtgcggcgggaagggctggcggtctttatgatcatgaaagaaggtgaaggctttaaaacctggatgtcgccgcagttcaaaacattcctggtgagcgataagaattaaaacgcaagattacgggtttttgtgggcggatttacggacacactgcatgtaagcaagcactatgcttaatgaaggagtctatgatgaaaaaagcgttacttaccgatgatgaatgctggctgcgggtgcaggcgcgcgatgccagcgcggatgggcgtttcgtttttgcagtgcgaaccactggcgttttttgccgcccttcttgtcgctcgaagcgggcgttacgtaaaaatgttcgcttttttgccaacgcgcagcaggcgctggacgccggttttcgcccctgcaagcgctgtcagccggataatgcgcgcgcgcagcaacggcggttggataagattgcctgcgcctgccgtttacttgagcaggagacgccggtaacgctggcgtctctggcgcaggcggtggcaatgagtccgtttcatctgcaccgtttgtttaaagcgagcaccggaatgacgccgaaagggtggcagcaggcgtggcgcgcccggcggctgcgtgaggcgttggcgaaaggagagccgatcacggcggctatttaccgcgccggcttcccggatagcagtagctactatcgtcatgccgaccagacgctgggcatgacggcaaaacagtttcgcaaaggcggcgataatgtctccgttcgctatgcgctgacggactgggtttacggacggtgcctggtggcggagagcgggcgggggatttgcgcgattctccccggtgatagcgacgatgcgctactggccgaattacacacccttttcccggcggcccgccacgaacctgctgacgcgccttttcagcaacgggtgcggcaggttgccgcggctatcaacacacgcgatgtgctgctctcgttgccgctggatatccagggaaccgcgtttcaacagcaggtctggcaggcgttatgcgcgattccctgcggcgaaaccgtaagctatcaacagcttgccgcgactatcggcaaacccacggcagtacgcgcggtcgccagcgcgtgcggcgcgaataaactggcgatggtgatcccgtgtcatcgggtcgtgcgtcgcgatggcgcgctctccggttatcgttggggcgtgcgtcgaaaagcgcagctattaaagcgagaagcgcaaaaagaggagtagcaatgctggatctgtttgctgatgaagcgccctggcaagagcccctggcgcctggcgcggtggtgttgcgccgctttgcgtttcgcgcggcgcagtcgctattagacgatatcggatttgtcgccagtcagtcaccgtttcgtcagatggtgacgccgggcggctacactatgtcggtggcgatgaccaactgcggcgcgttagggtggaccaccgatggtcacggttattgttatgccgtgcgcgatccgttgaccgataaaccctggcctgtgctgccgttatcgtttgccagcgtatgtcgtcaggcggcaatcgcggcagggtatgctagcttccaaccggacgcctgcctgatcaatcgctacgcgcctggcgcaaaactgtcgctgcatcaggataaagacgagccggatctgcgcgcgcctatcgtctcagtttcgttgggggtgccggcggtttttcagtttggcggcctgcgtcgcagcgatccgctccagcggatcttactggagcatggcgatatcgtggtctggggcggcgagtcccgcctgttttatcacggtatccagccgcttaaagcgggctttcatcccatgaccggtgaatttcgttacaatctcaccttccgtcaggcggctgaaaaagaataaaaataagaattattattgctgtgcaggtagagttagttaaactgcgggctgttattatcggtccgggttgtatgcatggaacttcttattcttgtctggcggcagtaccgctggccatttattagcgtgatggcgctgagcctcgccagcgcggcgctggggattggcctgatcgcgtttatcaatcagcgcctgattgaaacggtggacaccaccgtcatggtgctgccggaatttctcggtctgctcctgttgctaatggttgtcacattaggttcccaactggcgctcaccgctctgggacaccatttcgtttaccgcctgcgcagcgaatttatcaagcgcattctggatacgcacgttgaacgcattgagcaactgggcagcgcctctttactggccggtctgaccagcgatattcgcaatattactatcgcctttgtgcgtctgcctgagctggtgcagggcattgtcctcaccgtcggctcggcggcgtatctggcgatgctatcgacaaaaatgctgctggttacggctatctggatggcggtcactatctggggcggattcgtgctggtggcgcgggtttaccagcatatggcgaccctgcgcgagaccgaagataagctgtacaacgactatcagacggtgctggagggacgcaaagagctgacgctaaaccgcgagcgtgcggagcagatttttcagcaatgctataccccggacgccaaagagtaccgtcatcacattatccgtgccgatacttttcacctgagcgccgtcaactggtcgaatatcatgatgctgggggcgataggcctggtcttctggatggcgaatagtctcggctgggcggataccaacgtcgcggcgacctattcactgacgttgctgttcctgcgcacgccgctgctgtctgcggtgggggcgttgccaacgctactgaccgcccaggtggcgtttaataaactgaataaattcgcgctcgccccgtataagcctgattttccacagccgaaagcctttcccgactggaagacgctggagctgcgcaacgtggtttttcactatcaggataacgcgttttccgtggggcccatcaacctgacgattcaccgcggcgaactgctgtttttaattggcggcaacggtagcgggaaatcgacgctggccatgttattgaccggtttataccagccgcaatcgggaacgattttacttgacggtcaacctgttgccgccgggcagccggaagattatcgcaaactgttttctgcggtgttcaccgatgtgtggttattcgaccgcctgctggggccgcaggggaaacccgccaatcccgcgctggtcgaaaagtggcttgagcacctgaaaatgacgcacaagctggagctaaacgatgggtgcatcttgaatcttaaactgtcgaaagggcaaaaaaagcgcattgcgctgctgctggcgctggcggaagagcgcgatattattttgctggatgagtgggccgccgatcaggacccgcatttccgccgggaattttatcaggtactgttgccgttaatgcaggaaatgggcaaaaccattttcgccatcagccatgatgatcactattttattcacgccgatcgcctgcttgaaatgcgtaacgggcagttaaccgaactcaccggcgacgaacgtgacgccgcttcgcgtgatgcggttgcgcgtactgcgtaatggactatggcgccggataaactgcctgatggcagccctacgtccgcacgcgggtaggcctgataagatgccacgcgtcgccaccaggcatcggggtattttttgcggcgggcgagcgggtttccagacgtgttttaaaaagaaccccggagcgctgcgtgagtcggcgtgttcagatgcccggtaagtgtgaccgggcagcgtaacattatcgcgcgatggcattctgtacgttagcgtccgctttccagatgcggtatttcacgtccacattcgccggggtatacaccacgatcggcagcttgctgttgtagcgcagcatcccgtcttcacccagccaggcggtgacgaatttttgctctttcttaccttcagggcaggccatcatggttgataccggagaggtgacgttatcaaagacataatagtcgtagccccagccttccagcgtttttgtttccagcgtgccgccgaggcgatgctggttacaatccacattcagcgtttgaccaatcaacagttccactttgagggtagattcatcctgctgaggggtaagggttatcacttgccgcttcattcctttctccgcctgcggatagggggcgattttttccagcggctgggcggtatcgccattgttagcccaggcagaggcgctggcgagggcggcgaagacgacggcagggacaaacatcttcatttgattgttcacagtatttcctttctgctgttttcggtatgcacagacaacagattaacacattcatattatctattaatctgtatttactcatattttcaagattattaataaaataacgtctttttatatagtggaatattctgatattgataatgtaaatgaaattatcagctattagtgatttccgttatataaatatctatataactcattgaaatgtgagaaaaagcacgtttacgggtctttacccggcactcttttgatccggcaacagcatttacctctatcggggtatgcatctcttacacatcctgaaatatcttatttacaaaaataactactcataaattgtacggtttttattggcattcactccctatggaagcgtgtcgttatggaagggcgatatcatggttgatttatcccgtcgaagcatgttgaccggcagttggcgcaacgccagcaatgggattcttccgccgtgggccagagaaacgacctattttctcgcacattgtctgcgttgcgacgcctgcatccaggcgtgtgaggccgacatcctgcagcgagggacggggggatatccgagcgtaaatttcaaacggggcgagtgcagcttttgttatgcctgtgcgcaggcctgtcccgaatctctctttcttccgcgccgcaccagggcctgggatctgatttttacactcacggaaaactgcctcgccaggcagtcggttgaatgccatcgttgcctggacagttgtgaacctatggccattacctttcgtcccacgttatccggtatttaccagccgcagcttgactcgcaggcctgtaacggatgcggggcgtgtgtggctatctgtcccgtgtcagccatcaaagcggagaaccaccatgcgcactaactggcaggtctgtagcctggtcgtgcaggccaaaagtcagaacatcgccgccattggcacacagttgaacacgttgccgggttgcgaagtcgcgttaagcgacgttgaaagcgggcaactgatcgtggtggcggaagcagaccagagtgaaacgctgatgcaaacaattgagtcagtacgcaatgtcgagggcgtgctggcggtgtcgctggtttatcaccagcaggatgagcaaggtgaggaaacaccatgaaactcagtcgtcgtagctttatgaaagctaacgccgttgcggccgctgcggcggctgccggtctgagcgtgccgggcgtcgcccgcgccgttgtcgggcagcaggaagctatcaaatgggataaagcgccgtgccgtttttgcggaacgggttgcggtgtgttggtgggaacgcagcagggccgtgtggtcgcctgccagggcgaccccgacgcgccggtcaaccgtggtctgaactgcattaaaggctacttcctgcccaaaatcatgtacggtaaagatcgtctgacgcagccgatgctgcgcatgaaagacggcagctatcacaaagacggcgagtttacgccggtgagctgggaacaggccttcgatgtgatggaagagaagtttaaaaccgccctgaaagagaaaggaccagaagcgatcggcatgtttggatcgggtcaatggaccatctgggaaggctatgccgccgcgaaactgttcaaggctggtttccgctctaacaacatcgacccgaacgcgcgtcactgcatggcctcggcggtggtgggctttatgcgcacctttggcatggatgaaccgatgggctgctacgacgatattgagcaggccgatgcgtttgtgctgtgggggtccaacatggcggagatgcacccgattttatggtcgcgcatcactaaccgccgtttgtccgacccgaatgtgaaagttgctgtcctctccaccttccagcaccgtagctttgagctggcggacaacggtattgtctttaccccgcaaagcgatctggtgatccttaactatatcgcgaattacattattcagaacaacgcggtaaatcaggatttcttcacaaagcatgtgaatctgcgtaaaggggcgacggatatcggctacggcttacgcccgacgcacccgctggaaaaagcggcgaagaatccgggctccgacgcttccgagccgatgagcttcgacgagtataaagccttcgtggcggaatatacgttggacaagactgctgaaatgaccggcgtgccgaaagatcaactggaacagttggcacagctctacgccgatccgaataagcgcgtgatctcttactggacgatgggttttaaccagcatacccgcggcgtgtgggcgaataacctggtttacaacctccatctgctgaccggaaaaatctcccagcctggctgcggtcctttctcgctgaccggccagccttccgcctgcggtacggcgcgtgaagtgggaaccttctcacaccgtctgcccgcagacatggtcgtgacgaacgaaaaacaccgtgatatctgcgaaaaacactggcagatccccgctggcactatcccggcaaaagtgggtttacatgcggtggcgcaggatcgcgcgttgaaagacggcaagctgaacgtctactgggtaatgtgtaataacaatatgcaggccgggccgaacatcaatgaagatcggatgccgggctggcgcgatccgcgtaactttatcattgtctccgatccttacccgacggtgagcgcgctgtctgctgatctgatcctgccgaccgccatgtgggttgagaaagaaggcgcttacggcaacgccgaacgccgcacgcagttctggcgtcagcaaattaaagcgccgggcgaagccaaatccgacctctggcaactggtgcagttctcccgtcgttttaaaaccgaggaggtctggccggaggcgttgttggcccagaagccggagctgcgcggcaaaacgctgtatgacgttctattcgccacgcctgcggtcagcaaattcccgctgagcgagctgaaagaagatcagttaaacgatgagtctcgtgagctgggcttctatctgcaaaaagggctatttgaagaatacgcctggtttggacgtggccacggtcacgatctggcgccgttcgacgattaccacaacgcgcgcggtctgcgctggccggtcgtcgaaggcaaagagacgcaatggcgttacagcgaaggcaacgacccgtatgtaaaagcgggggaagggtacaaattctacggtaaaccggatggcaaagcggtgatcttcgcgctgccatttgaacccgcggcggagtcgccggacaacgagtacgatctgtggctttccaccggtcgcgtactggaacactggcataccggcagtatgacgcgccgcgtgcctgaattgcatcgcgccttcccggaagcggtggtctttattcacccgctggatgcgaaagcgcgcgatctgcgtcgtggggataaggttaaagtgtcgtcccgccgcggcgaagtgatttcgattgtcgaaacgcgtggacgtaaccgtccgccgcagggactggtgtatatgccgttcttcgatgccgctcagctagtgaacaacctgacgctggatgcgacggacccgctctctaaagagacggacttcaagaagtgcgccgttaagctggcgaaggtgtaacgcgttatgtcccgtacagcgaaaccccaaaatggccgccgccgctttctgcgtgatgttgtgcgcactgcgggcgggctggcggcggttggcgtggcgctgggcttgtaacagcaaaccgcgcgcgcaacgggcgtgcggctgcgtccgcctggcgcgctgaatgaaaatgttttcgccagcgcctgtgtgcgctgcgggcagtgcgttcaggcgtgtccatacgacacgctaaaactggcgacgctggcctccgggctatcggcaggtacgccctatttcgtcgctcgcgacatcccctgcgaaatgtgtgaagacattccgtgcgccaaagtctgccccagcggggcgctgaataaagatatcgcctccattgatgactcgcgcatggggctggcggtgctgctggatcaggaaaactgcctcaactttcaggggctgcgctgcgacgtttgctaccgcgaatgcccgaaaatcgatgaggccatcacgctggagctggatcgcaacatgcgcactggcaaacatgcgcgctttctgcccaccgtacacagcgacgcctgtaccggctgcggcaaatgcgaaaaagtctgcgtactggagcaaccagcgataaaagtgttgccgttgtcattggcgaaaggggagttaggacaccattaccgcttcggctggctggaggggaaagatggcaaatcgtaaacgcgacgccgggcgagaagcgcgggcgaaaaaaggctggtggcgtagccaccgttggctggtgttacgccgtatcagccagtttatggtgctggggatgtttctcagcggcccgtggctgggcttttgggttttgcatggcaactacagcagtagtttgctgttcgataccctcccgttgaccgatccgctgattaccctggaaagtctcgccagtggacatcttcccgctaccgtggcgctgacgggagcagtgattatcgctgtgctgtatgcgctggcgggaaagcgattattttgcagttgggtttgcccgctaaaccccgttaccgatttggctaactggatgcgcaggaaatttgacctgaaccagtcggcgacgattccacgccatatacggtatgtccttctggtggtggtgttaatcggttcggcgttgaccggcacgctgctgtgggaatggattaatcccgtgtcgctgttaggtcgtagtctgattatgggatttagtagcggcgcgttgctgattattgctttgtttttatttgatttattagtcgttgagcacggttggtgcggtcatatttgcccgatgggcgcgctgtatggcgtgctgggcagtaaaggcgtagtgaccgtgacggccaaaaaacgtgagaaatgtaatcgctgtatggattgttttcatgtttgcccggaaccgcatgtgctacgtgcgccggtgctggatgagcaaagcccggcgcaggtcactcaccgcgactgcatgacctgcggtcgctgcgtggatgtctgttctgaggatgtttttacaataacgatacacaacatcattcgggatgcatcgcggcggtaagcgaggaaatccccgggagcatagataacgatgtgactgggattttcgagcgcagccaacaaagaggcagctcgaaggatgaagtgtaaatgcgatggagttcgggagcgaaacaatgaaaagccatgacctgatgaaagcgctgtgtcaatggatggccacgcttgccctggtggtaagtggtgcggtttgggcggcaaacggagtggatctgagccagtcgccggaagtatccgggacgcaggaaggggcgattcgtatgccgaaagagcaggaacgtatgccgctaaattacgtcaaccagccgccgatgatcccgcacagcgtcgagggctaccaggtgacgaccaataccaaccgctgtctgcaatgccacggcgtggaaagttatcgtacgacgggcgcgccgcgtatcagtccgacgcactttatggacagcgacggtaaagtgtcgggcaacgtcgcgccgcgtcgttatttctgcctgcagtgccacgtaccgcagtctgataccgcgccgattatcgacaatacctttaccccctcgcaaggttacgggaaataagaggtcattatggaaaattctaaccgtaaacttggctggataaagcgcgtctggcgatggtggcgcagccccagccgcctggcgctggggacgctgctgttaatcggttttatcggcggcgtcatcttctggggcggcttcaataccggaatggaaaaggctaataccgaagagttttgtattagctgccatgaaatgcgcaacacggtgtatgaggagtatatggaaaccgtccactacaacaaccgtagtggcgttcgcgccacctgtcctgactgccatgtgccgcatgagtgggggccgaagatgatccgtaagatcaaagccagtaaagaactgtacgcgaaggtatttgggctgatagatacaccgcagaaatttgaagctcatcgcctgacaatggcacaaaatgagtggcggcgcatgaaagacaacaactcgcaggaatgccgtaactgccacaatttcgactttatggatctgaccgcgcaaaaaggcgtcgcggcgaaaatgcacgatcaggcggtaaaagatggacagacctgtatcgattgccacaaagggatcgcgcataaactgccggatatgcgtgatgttaaaccaggtttctgacaggacgttgatgagtgggaatgcttgaagccagagatctgtactgcgagcgggacgagaggacgctgtttcgcgggctgtcgttcaccgtggaggccggggagtgggtgcaggtcaccggcggcaacggcgccggaaaaaccaccctgctgcgcctgctgaccgggctggcgcgcccggacggcggggaggtgtactggcagggcgagcccctgcgccgcgtgcgcgacagcttccatcgcagcctgctgtggatagggcaccagccggggataaaaacccgcctgacggcgcgggagaacctgcactttttccaccccggtgacggcgcgcgtctcccggaggcgctggcgcaggccgggctggcgggatttgaggacgtgccggtcgctcagctctcggccgggcagcagcgccgggtggcgctggcccgcctgtggctgacccgcgccgcgctgtgggtgctcgacgagccgttcaccgccattgacgttaacggcgtggcgcgcctcacccggcggatggcggcgcacacggcgcagggcgggatggtcatcctcaccacccaccagccgctgccgggggccgcggacaccgtccgccgcctggcgctgaccggcgggggggccgggctgtgatgtggcgtgtcttctgtctcgagctgcgcgtggcgttccgccacggcgcggacatcgccggcccgctgtggttcttcctgatggtcatcaccctgtttccgttaagcgtcgggccgcagccgcagctgctggcgcgtatcgcgccgggcatcatccaggtggcggcgctgctggcctcgctgctggcgctggagcggctgtttcgcgacgacctgcaggacggcagcctggagcagctgatgctgctgccggtgccgctgccggcggtggtgctggcgaaggtgctggcccactgggcggtgaccggcctgccgctgatgatgctctccccgctggtggcgctgctgctggggatggacgtgtacggctggaaaatcatggcgctgacgctgctgctcggcacgccggcgctggggtttctcgccgcgccgggcgtcgggctgacggccggcctgcggcgcggcggcgtcctgctgggcattctggtgctgccgctgagtgtcccggtgctgattttcgccaccgcggcgatggacgcggcatcgatgcatttacccgttgacggctatctggcggtgctgggggcgctgctggcgggcagcgcgacgttaagcccgttcgccaccgcggcggcgctgcgcatcagtacgcagtagcgccccggcacgacggacattttactggtttcaggaggtcaggtgacgactatgtggaaaacccttcatcagctggcggcgccgccccggctgtatcagatttgcggcaggcttgtgccgtggctggcggcagccggcatcattgtgctggccacgggctgggtccggggctttggtttcgccccggcggactaccagcagggggagagctaccgcattatgtacctgcatgtcccggcggccatctggtcgatgggtatctatgcggcgatggcggtggcggcgttcaccgggctggtctggcagatgaaaatggccagccttgccgtcgcggcgatggcgccggtgggggcggtgtacaccttcatcgcgctggtcaccggcgcggcgtggggcaaaccgatgtggggcacctggtgggtgtgggacgcgcgtctgacctcggagctggtgctgctgtttctctatgccggggtcatcgccctgtggcacgcctttgacgaccgtaaaatggccgggcgcgcggcgggcattctggtgctggtcggcgtggtgaacctgccggttatccactattccgtcgagtggtggaacaccctgcaccagggctcgacgcggatgcagctgagtatcgacccggcgatgcgctcgccgctgcgctgggccatcgccggcttcctgctgctctttatgacgctggcgctgatgcggatgcgcaacctgattttactgatggaaaaacgccgcccgtgggtgagcgaactgatactgaaaagggggcaccggtgagtccggcattttcatcgtggagcgattttttcgccatgggcgggtacgccttttttgtctggctggcggtggcgatgaccgtggcgccgctggcgctgctggcgctgcacacggtgctgcagcgccgggccattctgcgcggcgtggcgcagcagcgggcgcgcgaggcgcggatgcgtgccgcacaggcgcaacaggaggccgcgtgaatctgcgacgtaaaaaccggctatgggtggtctgcgcggtgctggcgggcctggcgctgaccaccgccctggtcctgtacgcgctgcgcgcgaatatcgacctgttctatacccccggcgaaatcctctacggcaagcgcgagacgcagcagctgccggcggtgggccagcgcctgcgcgtcggcgggatggtgatgcccggcagcgtcaggcgcgacccggactcgctgaaggtgaacttcagcctctacgacgccgaagggtcggtgacggtgagctatgaggggatactgccggacctgttccgcgaggggcagggggtggtggtgcagggcaccctggagaagggcaaccacgtcctggcgcacgaggtgctggccaagcatgacgagaactacaccccgccggaagtggaaaaggcgatgcaggaaaaccaccgccgcccgcaacgcgctgataaggacacttcatcatgatgcctgaatacggccacgcactgctgtgcctggcgctcggcgtggcgctgctgctgtccgtttacccgctgtggggcgtggcgcgcggcgacgcgcggatgatggcgtcggccggggtgttcgcctggctgctgttcatctgcgtggcgggcgcgtttttcgtgctggtgcacgcctttgtggttaacgacttcaccgtggcctatgtcgccggcaactcgaacacgcagctgccggtgtggtaccgggtggccgccacctggggggcgcacgagggctcgctgctgctgtgggtgctgctgatgagcggctggaccctggcggtggcggtgttcagccggcaggtgccggcggatatcgtcgcccgggtgctggcggtgatggggatggtctgcgccggttttctggcgttcatcctgttcacctccggcccgtttgcccgcacgctgccggcctttccggtggaggggcgcgacctgaacccgctgctgcaggacccggggctgattttccacccgccgctgctgtacatgggctatgtcggcttctcggtggccttcgccttcgccatcgccgcgctgctgagcgggcgtctggacagcgcgttcacccgttttgcccgcccgtggacgctggcggcgtgggtgttcctgacgctgggcatcgtgctcggctcggcgtgggcctactacgagctgggctggggcggctggtggttctgggacccggtggagaacgcctcctttatgccgtggctggcgggcaccgccctgctgcactcgctggcggtcaccgaacagcgcgccggctttaaggcgtggacgctgctgttgtccatctgcgccttctcgctgtgtctgctgggcaccttcctggtgcgctccggggtgctggtgtcggtgcacgccttcgcctccgacccggcgcgcggaatgtttatcctcgcctttatggtgctggtcaccggcggctcgctgctgctgttcgccgtgcgcgggcacagggtgcgttcgcgggtgaacaacgcgctgtggtcgcgtgagtcgctgctgctcggcaacaacgtcctgctgatggccgccatgctggtggtgctgctgggtaccctgctgccgctggtgcacaaacagctggggctgggcagcatttcggtgggggagccgttctttaacaccatgttcacctggctgatggtcccctttgccctgctgctgggggtggggccactggtgcgctggggccgggaccggccgcgtaacatcaggaaactgctgctcaccgccctggtctccaccctggtgctgtcggtacttttgccatggctgctggaagatagaatcatcgccatgacggcggtggggatggcgatggcctgctggattgcggtgctggcggtggccgaagccgtacagcgcgtgtcccgcggcacgaaaacctctctcagctactggggaatggtggcggcgcacctcgggctggcggtgacgattaccggtatcgccttcagccagaattacagcgtggagcgtgacgtgcggatgcgggcgggcgacagcgtgaccattcacgactaccgcttcaccttccgggaggtgcgggacatcaccgggcccaactaccgcggcggggtggccctcatcggggtgacgcgccacggcgagccggaggcggtgctgcacgcggagaaacggctctacaacaccagccggatggtgatgaccgaggcggcgattgacggcgggctgacccgcgacctgtacgccgcgctcggggaggagctggacaacggcgcgtgggccgtgcgcctgtactacaaaccgtttgtccgctggatatgggccggggggctgctgatggcgctgggcgggctgctgtgcctggcggacccgcgctaccgccgccgtaaaccattgccggaggccggatgaaacgcaacgtactgttattaccgctgctgatttttctgctgattgccgcggcgctgctgtggcagctggcgcgcaacgcgcagggggatgacccgacgaatctcgaatcggcgctgaccggaaagccggtgccggcgtttcgcctggaatcgctggagacgccgggtcagtactatcaggcggaggtgctgacgcaggggaaaccggtgctgcttaacgtctgggccacctggtgcccgacctgccgcgccgagcatcagtacctgaaccggctggccgcgcagggtatccgggtggtggggctgaactataaggacgaccgggcgaaggcggtggcctggttaaaggaactgggcaacccgtatgcgctgagtttatcggacagcgacgggatgctggggctggacctgggcgtgtacggcgcgccggaaaccttcctcatcgacggcagggggattatccgctaccgccatgcgggcgatttgaatgcccgggtatgggaaagtgaactgaaaccgctgtgggacagatacagccgggaggcggcgcaatgagactgttaccgggcatggtgatgctgatgctggcgctggttatctccgggtcagcgcgggcgaccaccgacgtgatgccgtttaaagatgaagcgcaggagcagcagttccgccagctcacggagcagctgcgctgcccgaaatgccagaacaacagcattgcggactcgaacgcgatgatagccaccgacatgcgccgcagggtgtatgacctgatgcaggaggggaagagccgccaggaaatcatcgattacatggtggcgcgctacggcaacttcgtcacctacgacccgccgctgaccccgctgacggtgctgctgtgggtgctgccgctggccgccatcgtggcgggcgggtggataatcgtcgcccggacgcgccggcgggtgcgcctgcgccgggagccgctgccggcggacaccccggtttgcggcgcgcgcgccgggtggggcgtttacgtgccgggggccgtcattgcgctggcggtcggcgccggcagctacgccctgaccggcagctatccgcaggtgagggcctggcagcaggcaacggcgcagacgcccgggctgctggcgcgggcgctggacccgcaggcgcagccgctgaatgaggaggagatggcgcggctggcgctggggctgcgcacccgcctgcagaatgatgccggcaatgttgagggctggctcatgctggggcgcaccggtatggtactgggtaatgccggtaccgccaccggggcgtatgcgaacgcttaccgtctggacccggaaaaccgcgatgcggcgctgggctacgcggaggcgctgacgcgctcgtccgacccggaggataaccgccgcggcggggaactgctgcgtcagctggtgagccgcgaccacacggatatccgggtgttaagcctgtatgcgttcagcgcctttgagcagcagcgctttggcgaggcggtggcggcctgggagatgatgctgaagctgctgccggcgggtgacgcccggcgggcggtgatagagcgcagtatccggctggcgcaggagaaataagaccctgacggcccggtggcgtggcgccaccgggcctggcttgttactgcattccgcgtgtttgtaaaaatagaatggtcgccgcgacgcgcgagcgcacgtttagcttgcgaagtagattacgaatgtgcaccttaaccgtctgctcagaaatattcagtactgacgcaatctgtttgttagaaagcccctgcgccagctcatgcaagacatctaactctcgttcggtcaggatactaaagggatcttcctgcgcgccaaaccgttcacgctcacgcagatattcattgacccgatcgctaaagactttaccgccgttagcgcctttgcgaatggcctccagcagcacttccggatcgctatctttgagcagataaccgtcggcgccggcgtcgatcagcgcgtagatgtcgctggcggaatccgagacggtaagaataataatttgcgccgtcacaccatcccggcgtagcgcgttcagggtatctaacccgctcagacctttcatattcagatccagcaggatcagatcgggctcaatgcgattcgccagatcgatcgcactcgccccgtcacccgcttcggcaacgacataaaaagccgggtccagttccagtaattgacgaatacctcgccgcataagtggatggtcgtccacaataagcacctgaaaaggtgttacttcaggcatgctatatctcctgagttttattagaatgattattgttttcagcgcggaaatcgtccagatttgccacattgtcaagcgcgtaaattttaccttaattagtgcatgggtaagtagtaaaacctgtgacaggcgagtcattagctgaacgatagaaaggataaaacaacctgttgtgagagaaaacagaatactccctgaagttgaatactggtctggacgcttttttcggacaatgtgacataacagaagtgtggcatatgtagctgcgcccttgcgtccgtaagtccagactatctttactggcaggaaattccttattaaaagtcatagcgtctaaagattttcattattaacaaattattttaattgaatttatttatggttttattaatgccaatgaaatacatctgagcagaacgaataaaccgcgacatctgttaaattaaatattaagtcaatagcagaggtatttttatgcgataaagagattctgacgatattcttatcataaatgaaaatgtggtcaggaatgagcgtcattcacttataacttatcctggatgtgcctgaacaacactcgcggcgttttgagcacccgttggggcgactcaaggggagaacgtagtgtggatgctatatcagccgtttctgtgagcgtaagcgtggcgtagaaaattttaaatatgttagccggttaaaaataactattgacattgaaatggtggtggagtgtatatgaagagaatatttatatatctattattaccttgtgcattcgcatgttctgctaatgataatgtttttttggcaagggcaacaagcatcagatctcttttgctgcgggagaaagtataagaagaggaggggttgagcacttatatacggcttttctgacatacagtgaacccagcgattttttctttttacaggcaagaaataatctggagttaggaggatttaaggctaagggtagcgatgattgcagtaaacattctggcagcgttccctgtaataaatataaccagggcgtattgggtatctcgaaggatgtggcgctggttcatttcgctggtatctataccggtattggtctgggggcttatataaaatctaagtcgcgagatgatatgcgtgtcaattctgcatttacctttggagaaaaagcgtttcttggctggaactttggggctttttctacagaagcttatatccggcatttctcgaatggatcacttacggataaaaattcagggcataattttgtaggtgcttcaattagttataatttttgaagttgaataacaattagcgagttgctggctgaaggagtaattaatcaccgtacgttgtctacaaaacgtgttgtgaatagccgatcgttatcgaccctatggcgacagggaggctaattgttagcgacaaaggcgtggtaggccgtttaccttaccagaacgttttattattgctgcgacagattgcttactcatttacctgccactgcaaacattttttccagtatagggtgtagatgcgctttttctgttttagtacaaacatggtttacgttagttgcctgcattgactttactgtgaccactgcacaggaaagatgtccaatcagttcatgcaaaatcagttcatgcaaaataacgtctctggcatcagctaactttttaattgtaggcataaaaaaaccagccctgacaggctggttttcaaggggaattttggtcggcagcttcatccgcagcatctgcggagagcagcgcaggtacggcgaccacaaaagccggggaggcatcagccagcgcggcgtcggctgacacagccagaacggcggcagccgcctcgtcatcagcatcgtaggcatccacccacgccgccgcatctgataccagcgcatcactggcagcgcaaagcagagctgcagccggagaatcggcaaccagagctgaagaggccgcgaaacgggccgaggatatcgcagacgtgatttccctggaagatgcaagcctgacgaaaaaaggtatcgttaaattaagcagtgccacggacagtgacagcgaagcgctggcggccacaccaaaggcggtaaaaaccgttatgggtgaggtacggaccaaagcgccgctggacagcccggcattcactggaacgccgaccacaccgacgccgccaggcgatgctaaagggcttcagacaacaaacgcggagtttgtccgcaaactgattgccgcgctggttggttccgtactggagccactggacaccctgcaggaactggctgacgcgttgggaaatgatccgaactttgccaccacggtactgaataaactggcgggcaagcagccgctggacgaaaccctgacggcgctgtcaggaaaaagcgttgacggtcttatcgaatacgttggtttgcgagaaaccataagtcgtgccgccgatgcattacaaaaatcacagaatggcggcgatattccggacaaggatttgtttgtgcgtcgtatcggtgccgcgcgagcgtttgatggcgcagttattatcggctgtgatgataatccgtggacgacggcggagtttatcgtctggctggagtctcagggcgcattcaatcacccttactggatgtgtcgtggctcctggtcttacgcttataacaaaatcatcacggatactggctgcggtaatatctgtctcgctggcgcagtgattgaggtaatgggagtgcgtggcgcgatgactattcgggtgacaacgtcccattcagtatctggttggtgatacgtgggtgacagccccaagtgtataagaaggaataattatgacagcggaaaaaaaataaaaagaacaaacagtttttaaatattaaaaatttcattccgtatgcaccggaaccagatgacacattattcgccgatgcggcgtatcttaaatcagaggatggtcaggactggtatgggtgccagcaattattttcagcagacacgctgaaaattacctacgacgataacgatgttattacgtgtattacgcgtgatgtttccgggctgtggcctgctggccagagcgttgcagagttgcctgatacggatgaaaaccgtcgcgctgatattcatgctgctggcagtttaaagacggtaaagtcgttcaaagggtttattcgccggaagagctgcgcaggcaggcagaatcgaaaattgaacgcccgggcgttgataccggatgatctggtcatcgtggaaagcgaccctgaaaaaatcgacactttagctgtaaaatgacagtcccgccatccggtcatcataacggatttttcttctgcaccttctgaagcccgccatgtcaggacgaccatgaatccgccgataaccttattgtgaaattaagaccaggaagagatgatgtctgccggacagatactatatgtaaatttataaaggttttttgttatgccctttcatattggaagcggatgtcttcccgccaccatcagtaatcgccgcatttatcgtattgcctggtctgataccccccctgaaatgagttcctgggaaaaaatgaaggaatttttttgctcaacgcaccagactgaagcgctggagtgcatctggacgatttgtcacccgccggccggaacgacgcgggaggatgtgatcaacagatttgaactgctcaggacgctcgcgtatgccggatgggaggaaagcattcattccggccagcacggggaaaattacttctgtattctggatgaagacagtcaggagatattgtcagtcacccttgatgatgccgggaactataccgtaaattgccaggggtacagtgaaacacatcgcctcaccctggacacagcacagggtgaggagggcacaggacacgcggaaggggcatccgggacattcaggacatccttcctccctgccacaacggctccacagacgccagcagagtatgatgctgtctggtcagcgtggagaagggctgcacccgcagaagagtcacgcggccgtgcagcagcggtacagaaaatgcgtgcctgcctgaataatggcaatgcagtgcttaacgtgggagaatcaggtcttaccaccttgccagactgtttacccgcgcatattaccacactggttattcctgataataatctgaccagcctgccggcgctgccgccagaactgcggacgctggaggtctctggtaaccagctgactagcctgccggtgctgccgccaggactactggaactgtcgatctttagtaacccgctgacccacctgccggcgctgccgtcaggactatgtaagctgtggatctttggtaatcaactgaccagcctgccggtgttgccgccagggctacaggagctgtcggtatctgataaccaactggccagcctgccggcgctgccgtcagaattatgtaagctgtgggcctataataaccagctgaccagcctgccgacgttgccgtcagggctacaggagctgtcggtatctgataaccaactggccagcttgccgacgctgccgtcagaattatataagctgtgggcctataataatcggctgaccagcctgccggcgttgccgtcaggactgaaggagctgattgtatctggtaaccggctgaccagtctgccggtgctgccgtcagaactgaaggagctgatggtatctggtaaccggctgaccagcctgccgatgctgccgtcaggactactgtcgctgtcggtctatcgtaaccagctgacccgcctgccggaaagtctcattcatctgtcttcagagacaaccgtaaatctggaagggaacccactgtctgaacgtactttgcaggcgctgcgggagatcaccagcgcgcctggctattcaggccccataatacgattcgatatggcgggagcctccgccccccgggaaactcgggcactgcacctggcggccgctgactggctggtgcctgcccgggagggggaaccggctcctgcagacagatggcatatgttcggacaggaagataacgccgacgccttcagcctcttcctggacagactgagtgagacggaaaacttcataaaggacgcggggtttaaggcacagatatcgtcctggctggcacaactggctgaagatgaggcgttgagagcaaacacctttgctatggcaacagaggcaacctcaagctgcgaggaccgggtcacattttttttgcaccagatgaagaacgtacagctggtacataatgcagaaaaagggcaatacgataacgatctcgcggcgctggttgccacggggcgtgagatgttccgtctgggaaaactggaacagattgcccgggaaaaggtcagaacgctggctctcgttgatgaaattgaggtctggctggcgtatcagaataagctgaagaaatcactcgggctgaccagcgtgacgtcagaaatgcgtttctttgacgtatccggcgtgacggttacagaccttcaggacgcggagcttcaggtgaaagccgctgaaaaaagcgagttcagggagtggatactgcagtgggggccgttacacagagtgctggagcgcaaagcgccgaaacgcgttaacgcgcttcgtgaaaagcaaatatcggattatgaggaaacgtaccggatgctgtctgacacagagctgagaccgtctgggctggtcggtaataccgatgcagagcgcactatcggagcaagagcgatggagagcgcgaaaaagacatttttggatggcctgcgacctcttgtggaggagatgctggggagctatctgaacgttcagtggcgtcgtaactgatgcaccaggtgaatgaggtgcggtgcgacaaagatattcccggacgaacaacatcagacagtacggatgatgtacaggtgaaataggggagacttcttcagtcagggcgcggcgcaactttttcgatgataacgcgccgcgcgccggtagcgagaagccgatggaagtactggatcacctgaatgcaaagaagggcaggggaaagctgtactttgccggggagggtatccagcaacagtgggctatgaagagaaacatactgtcatcccgatataccacccgctatgaagacctgcttcaggttaagtgacaggtttactctgattttcaaatttctgatgtgatggtgtgccgcagccacattgtatgcaagaacgggctgcggcaaactggcgatcgttcgatagtgcgtgtattgaatagttaccagtcgtggcggattctactggttaaggatgactaatcaatgtatttaagtcatctgttcaacttttcgcgttggagggagcttgaagtcaatttgcagtgaccttcgatagctatttcaccatcatttcaccatttgcaaattggatatataaaaaaaccagccctggcaggctggcttttaaggggaattttggtcggcacgagaggatttgaacctccgacccccgacaccccatgacggtgcgctaccaggctgcgctacgtgccgacttgtgggtgctaatactacctctttccaatgcgaatgcaaggggaaacggtgctaactgatttataattaatcagttagcgataaaacgtttctcttctgttagcacttgcagcagcagactgagctgcggcttctgatctttgatcttctcgccgtgtaagtcataggtctgataatgaccgttattattgagcaccagggtcatttgcggcgtcgtgattgccagcgtactgccgtctgccgccgttacccagttatgacgacgtggaacggtaaagatgtcctggccctgtgaatattcgttcgctggcgtgctgacatgtaacaggcgttgcatcaacgtggtcatcacatcggtatgatcggtaagcacattaatacgctgcgcaggcgtccccggccagtggatcaccagcggtacttgcagatgaccttgcgaccagtcgaagcgattttcttccggcgtcaacggtatgccgcgtcctgcggtaatgatcacgacagtattgtcgaatttaccggcctctcgcagcgcgttcagaacccgattgatttgcgcatccacgtcgctggcggcactggcgtaacgcttaacaaaatttttctggttactgtcatcaatgttagtaccgttaaacgatatccatgagaaccagcggttatcttcctgtgcgtagcgcccaagccagtctatccactggctggccgtttgcgcatcagactgcgtttgcgctgccggcatcgagaaatcggacagtaatgcctgacgataaagcgggctggcgaagccatccgaagaaaacagtcccagttggtagccttgctgattcaacgcggtaatgagcgccgcaggcgttctggtggataacacgccatccatatagcctggcgatatgccatagaacaggccgaaaataccgttatcagtggtattccctgaactcatatgacgggtgaagtcgatgttttgctcggcaaatgtagccagctccggcatctgcttctcaaagcgagaatagttcaggccgtctacggtaatgagcagcacattctgaccggtgcccatatcgcgatagtgcaaattgctgagcgggtactgaacggagaccgcttccggattgccttgctctaccagacggcgctgatattcctgcgcatccagcagaccgtgtttttcaagaaaacgtcgcgccgtcatcggataagagagcggcaggtttgcccgctgcatggtaatcggccggtaaaaattagcgtctgcccagatgtagataagatgcgatgcgataaaggagacgaaaaagaatgccgcaagcggccttgcgaaatggcggcggcgcgtgagactgcgcagcttttgccaactccatgtcgcaaatagcatctcaatcaataagataactggcacgctaataaacataagctgccagtcgcgcgccatttcgttctggtcagggttgatgaccagttcccagacaatggggttaagatgcaggtgaaaacgggtaaagacttcgctgtcgataagcaacaacgtcatacccgcggtcgccagaatggctgataaaaaccgcatcagccgctgggacatcacgataaacgtgagcggaaaaagaataagcaaataggtggcgaacaccagaaagctaaagtgcccgacaatgctcaggtaggagtatatgcgacccgcaagcgttgtcggccagtcggcgacaaacaggtaacggctgccgagcaacgtagccaacagtatattgaacagagcgaaccagtgcccccagctaaccatctgggagactttttcacggtagcgctgacgatgagttaccatacctgtcgcttgtttctccggagtcggctttttagtgcgcgttgtcttcgctaatcgaagactgcaaggcgcgggcaaaagagttcgcaatcgcctggcgttgagccggcgccacgctggtgttgataaggttggtgaccatatttcccagtaccatcagggaaagatcggtcggcgccttatgtttttccagtacactgagcagttcgctcagcagttgttcaacatgttcatcactatagcgggagagttgtggcataaatcaaaatctgtttgttcatgaaagggcaacatattaccgtagcaacagttttttttctgcatttttatcccctaaatcattcgcgttacggataacgcctgaaatgacagggcgattgcttgcgtcttccggcaggcggtggttgaataccgcccggtcttaaaggagagtttatcatgagtctggatatcaaccagattgccctgcaccagcttatcaagcgcgatgagcaaaatcttgagctggtcttgcgcgattcattgctggagccgacaaccaccgttgtcgagatggtggctgaactgcatcgggtctatagcgccaagaataaggcgtatggcctgtttaatgaagagagtgaactggcgcaagcgctgcggttgcaacgtcagggggaagaagattttcttgcctttagccgggcggcgaccggacgcctgcgtgacgaactggcgaaatatccctttgcggacggcggcattgtattgttctgccattatcgttacctggcggtggagtatctgctggttacggtactgaacaacctgagcagtatgcgggtcaatgaaaatctggacattaacccgacgcattatcttgatatcaaccatgcggatatcgtggcgcgtatcgatcttaccgagtgggaaactaatccgcaatcgacccgctacctgacgttcctgaaaggtcgggtagggcgcaaggtcgctgacttctttatggatttcctcggcgccagcgaagggttgaacgccaaagcgcagaatcgcggcctgttgcaggcagtggatgatttcaccgcagaagcgcagttggataaagcagaacgtcagaacgtgcgtcagcaggtgtacagctactgcaacgagcagttacaagccggggaagagattgagctggaatcgctgtctaaagagctttccggcgtcagtgaagtcagcttcagcgaatttaccgccgaaaaaggctatgagctggaagagagcttcccggcagatcgcagtacgctacgccagttaaccaaatatgccggcagcggcggcgggttaacgattaactttgatgcgatgctactgggcgagcggattttctgggacccggcgaccgataccctgactatcaaagggacgccgccgaatttgcgcgatcagttgcagcgacgcacgtcgggcgggaaataaaggcatacgacataaaaggacgccgtagtgagtaaaggaatacgtcagaggccgcctgttaatttcagtttatttcggcaggttttgtatgcgcacattgtcgcatttttgatgatgttgatgctcggcatggtgttcaccgttctctcgttggtactgttttatacttatggcgccaactggttactgagcttgttcatatgcccgctgttcttgttaagtggtttattcattactggatttgcttttaaatcaacctggtccagcatacgttactattacgacaaggggcagttgaaacggtatggactcaatcttgatgcaactttgacgcataaagagaaggtggaaatacgcatcgataatgcaaagcgtcaagtgcgtgtagatgaactggaactccatgtcttatttgattttcagtttgatagcaagacatggagctgcggcgacttactgaccaatgaaaaggtatttgatgcgttgaatgatgggcaaacgataccaatacgaattttgccatggaaaccggaaagtgccagcgttcgtcaacgggcattattcaatcggcttaaaggtatgaataccgcggcggaaactacagatcctcgattaggggaggcgctaattgaatgtggcgaggtgtaagaaagcagaaaagcaaagtgggttctcgttgctctgcatgtcgtcaaattcaattaaacgcataaaaaaaccccgccggggcggggtttttcttcaacttccaggcgattacgcgcgaacgaagtcgatgtgagtcagcttcggtttgtaagcgtgacgctgtacagcctgagctttaacttttacttctttaccgtcaacaacgagggtcagaacttcgctgtagaattcagctttagcttgcatgttcatcacctggtcgtggtccagttcgatagcaatcggggcttcagaaccgccgtagatgattgccgggaacttgttagcggcgcgcaggcggcggctcgcacccttaccctgctctttacgtacttctgcgttgatagtaaacatttaaatctctctttaataattcctgctacaggcgacccagcaacaggtaagtgatctgctttgcgtatgcaaaggcgggcgggattctatactcaaatcgccgttacatcaatgaaaagtacaattaaccacgtaattcgtgcgcccggcggaagcggccttcatagtcgaacactttttcacgcacctgccagtactggcctttcatccgcgcgaccacaaaatcgggatgccgcaacagcgcctgctgcgcgacaatatccgccgccgtgatccagcgtaaaggaacgccgggcgtgcgcgtatgcgggcgaataaatagctgttcgaaagcggtacgctgggcgggcgtgtgcaagcggaagcgctcactgacatccgcgccgtcctcgtcatagtaagtgattttcagccattcgcctttctcatcctgcccatgctgcatcgtcattccgctacagcgcaggactaacgcatccttgagcctgagcgccgcttttaacatatcgtccgggtcgaccagaatggcgtcacattcccggcagcgtcgggcggcaatatcgttttcggcattacactgcgggcagtttttgaagcgaaagcgaaaatcgcactgctcgcgatggccgtcgtcatcctcaaaccagccctggcagcgacggccaaagtgttcaatcagcgtgccgtcggcagtggttttcccccagaaggtgttggcaaagccgcaggccgggcaaaatacctggacagggacgttatcgctttttcccttcgggctaccgacctccggggcatacaggtcgtgcgggttgcctgcgtaatcaagaatcaggcaatcggtctttcccggcgcaaggcgcagaccacgcccgacaatttgttggtaaagactaactgactccgtgggacgtagaatcgcgatgagatcaacgtgtggggcgtcaaagccggtggtcagtaccgagacgttaaccagatagcgaaaacgctgcgccttgaaattatcaatcagcgcgtcgcgctcgggccctggcgtatcgccggtaatcagcgccgcgtcgtccgccggaagcagaccgacaatctctttcgcatgttcgaccgtggcggcgaaaatcatcacgcctttgcgcgtttgcgcaaattccataatctggctgatgatgtgcggcgtaatccgctgctgctttttcagctcgcggttcaggtcggcttcgctgaacagcccattgctttgggcctgcaggcggctgaaatcgtattggaccactggcatatcaagccgctcaggcggcgtcagatagccgtgtttaatcatatagcgcagcggcagttcataaatacagtcgcgaaacagagcgttgtcgttgccgcgcaccataccgtgataatgaaattgataaatccagccttttccgaggcgaaaaggcgtggcggtgagtccaagcagacgtaagtgaggattaactttactcaggtgagtgaggatttgctgatactgactgtcttcatcgtcaccgatgcggtggcattcatcgacaatcaacagcgaaaactcctcctggaaggcgtcaagattacgcgccaccgactgtacgctgccgaacacgactttgccctgactctctttacgtttgagtccggcggcgaaaatatccgcttccagccccagcgcgcaatatttggcgtggttctgcgcgaccagctctttcacatgcgccagcaccagtacccgtccgcgggcgacgcgcgccagttcggcgatcaccaggcttttacctgcgccggtcggcagaacaatcacggcgggcgtacggtggcggcgaaagtggctgagcgtggcgtctacggcttcttgctggtaggggcggagtgtaaaaatcatggtctcactacgttaaacggttccgggaatagtatgccatgaatcatttcccttgagggatatagttagcccgctatactgagcggatagcaattcccttttttcgggtagaatgcccgatttccgtattattacaggctaaatcacacacatgcgacttgataaatttatcgctcagcagcttggcgtcagccgcgctattgccgggcgtgaaattcgtggtaaccgcgttaccgtcgatggcgacatcattaaaaatgcggccttcaaactgctctcggaacatgcggttgcgtatgacggcaatcccttagcgcagcaacacgggccacgctattttatgcttaacaagccgcagggatacgtttgttcaaccgatgatcccgatcatccaacggtgctgtatttcctggatgagccggtggcgtataagctgcatgccgcaggacgtctggatatcgatactaccggtctggtgttaatgacagatgacggtcagtggtcgcaccgcattacgtcgccgcgccatcactgtgaaaaaacctatctggtgaccctggagtcgccggtggccgacgatacggcagcgcaatttgcgaaaggcgtgcagttgcataatgaaaaagatctcactaaacccgctacgctggaggtgataacacctgtgcaggtccgtctgaccatcagcgaaggccgttatcatcaggtgaagcggatgtttgccgcagtaggcaatcgcgttgtggaactgcaccgcgaacggattggcgccattacgctggatgagaatctggctcccggcgagtaccgcccgttgactgaagaagaaatcgccagcgtcggctaactatctcgttaaattcaggagttcgatgtgaccacccggcagcactcttcctttgccattgtctttattcttggcctgttggccatgttaatgccgctgtcgattgatatgtatcttccagcgctgccggtgatttctgcgcaattcggcgtgcctgccggtagcgcgcagatgacgctcagcacctatattctggggtttgcgctgggtcagcttatctatggaccgatggcggatagcctcgggcgtaagccggtcatcctgggcgggacgctggtatttgccgctgcggcggtcgcctgtgcgttggcgcagactatcgatcaactgatcgtgatgcgtttctttcacggtttggtggctgcggcggcaagcgtcgtcatcaatgcgctgatgcgggatatttatccaaaggaagagttttcgcgcatgatgtcatttgtcatgctggtcactacgatagcgccgttaatggcgcccattgttggcggctgggtgttggtatggttaagctggcactatatcttctggatactggctattgcggcgattctggcgtcagtcatgatctttgctttgattaaagagacgctgcccgttgagcggcgtcagccttttcatattcgtaccacaataggtaactttgccgcgttgtttcgccacaaacgcgtactgagctatatgctggcgagcgggttcagttttgccggtatgttctcttttttgagcgcggggccgtttgtctatatcgaaattaatcatgttccgccgcaggatttcggctactacttcgcgttgaacatcgtatttctgtttgtgatgacgattatcaacagccgttttgtcagacgggtaggggcgctaaacatgtttcgggccgggctatggattcagtttgcgatggcggtgtggatggttttcagcgcgctgatgggcattggattctgggcgctggtggttggcgttgcggcgtttgtcggctgtgtgtcgatggtttcgtccaatgcgatggcggtcattttggatgagtttccgcatatggccggaacggcgtcttcgttggcgggcactttccgctttggtattggcgctatcgtcggcgcgttgctgtcgctggctacctttaacagtgcgtggccgatgatctggtcgattgcgctttgcgccgcctgttccattctgttttatctctacgccagccgtcccaaaaaacggtgacgggcgcggtgtccctcaatggcgccgaagaatgcgcaggcggcgttggggggcgctatccgctacacgatggcaaagccaaacggctttcatagttgatgtatatcaattaccaattcatcattttcctcctttatgtttattttatgtaaaatccatttatgtaaaaagtcacatcattgtagttaaaaaggttgagttagatcgcagaaacgggtacatatagcccgccgctatctccgcgtcggtaaaactattttaactcccgcttgctgtagagccactgacggagagaagggcgttagcaatctgtttaaggacgggttgtcaatgatgtgttaatataaatgtaagtaaattgtgaagtaattgtgcttccggggaaagaaagtgaatacattacagctctcaattgttcaccgtctgccgcaaaactatcgctggtcggcgggttttgcggggtcaaaggttgaaccgattccgcaaaacgggcagagcaccgagaatagtctggtggcgcttaaactgttgagtccggcaggcgatagcgcgtggtcagtgatgcataagctcagccaggcgctaagcgatattgaagttccttgctccgtgctggagtgcgaaggggaaccgtgcctgttcgttaatcgtcaggatgagtttgccgccacctgtcggctgaaaaatttcggcgtggcgatagcggaacctttttctaacaataatcctttttaggcgtcagcttaacgcgagtagctgacgcgtatacgcttgttgcggtgcggtaaacacgcgctcgcattgcccctgttcaaccacctccccctgtcgcagcacgataacctgatggcacagcgcgcgtactacatgcagatcgtggctaatgaagatataggccagacggtgcttttgctggagcgatttcaggagggcaagaatctgcgcctgaacggttttatccagcgatgaggtcggttcatccagaataataagcgacggttttaaaatcagcgccctggcgacggcgatacgttgacgctggccgccggaaaactcagcggggtaacgatgccgcgtttccgggtccaggccgacttccatcatgaccgctttcacctgctgttcgcgctgcgcgcctgaaagcgtaggctggtggacgcgcaggccttcttcgataatttgcaatacgtttaaacgcgggtttagcgatgagttcgggtcctggaatacgacctggatacggtggcgaacaggtaaaagctggcggcggtttaacgtatccagcgattgaccgtcaaacacgatgcggccttcggagcggataagccgtaacagcgccagaccggtggtgctttttcccgatcctgactcgccgaccagacccagcgtttcgcctggatgcagggtgaaactgatattgttaaccaccacattatgatccacgacgcgcttcagaatgcctttgcggattgggaaggcgacgcgcagcttgtccacttccagcaacggcgcctgcccggcggggagcggaaccggatcgccagtgggttcgctgttgagtagtttttgcgtgtacggatgggtcggcgcggagagcagcgtgtcggcgcgttggttctctacgcacttgccgtgttgcattaccgccactgaatccgccagtttttttacaatgctgaggttatgggtgataaacagcaatcccatattgagctcacgctggagttcccgcagtagagataagatctgcgcctgtacggagacgtcgagggcggtggtcggctcatcggcgatcagtaattccggccgtgttaacagcgccatggctatcatgacgcgctggcgttcgccgccggaaagctgatgcggataatcgcgcagacgctggctcgcctggcggataccgacccgatccagacaaccgatcatctccgcccttgccgcctcccgacgcattccccgatggagcgacagcacttcatagagctgtttttccagcgtatgcagtgggttaagtgaaaccatcggttcctgaaaaatcatggcgattttattgccgcgtacgccgcgtagcgtctgctcgctggcatgaagcaatgattcgccgtgaaagcgaatatcgccggagaggtagacggcgggaggggtaggcaaaagacgcagaatggaaagcgccgtcacgctttttcctgatcctgactcgccgaccagcgccagcgtttccccggcgttcacctgtaacgaaatggcgttaacgacagggcgcacgtgctgttgctgacggaaacctaccgataaattttcaatcgcaagcaatggagatgtcatcttataccgccttagcaggatcaaaggcgtcgcgtaccgcttcgccgataaaaatcagcagcgatagcagaatggcgacagacagaaaggcggcgatccccagccagggagcctgtaagttgtttttcccctgtaaaagaagttcgccgagagaaggggagccaagcggcagaccgaatcccagaaaatccagcgacgtcagggtggtgatggaactacataaaatgaacggtaaaaatgtcagggtagcgaccatcgcattaggcaacatatggcgcaggataatgtcacgatcgctgacgccaagcgcctgcgcggcgcggatatagtcaaaattgcgggtccgtaaaaactcggcgcgcaccacgcccaccagactcatccagccaaacagcacggttatggccagcagccaccagaagttaggctgcactacgctggaaagtaaaataatcagaaacagggtcggcatccccgaccagacttcgatgagacgttgcccccataaatcgactttgccgccataatagccctgtagcgcgcccgccagtacacccatgacgctggagcaaatcgttaacatcaggccaaataaaatagaaatgcgggtgccgtacaggatgcgggcgaaaacgtcgccgccattcgcatcggtgcccagccagtttttcgccgaaggcggggaggggaaaggctgcgtggtggcaaaattaatggtattggcgccaaagcgtacgggggcccacaacacccagccccgattctcaagctgccgttgtagccaggggtcctgatagtctgccgttgtcgccagcgggccgccgaaatcgcgctcgctgtaattttttaccagcggaaaataccactggccttcatagcgcaccagcaatggcttatcgttagcaatcagttccgcgcataagctcaggctgaacactaccaggaaaatccatagtgaccagtagccccggcgattatggcggaaacgcgcccagcgggcctgattgaccgggcttaatcgcggcattatcgtccctcaaaatcaatgcgtggatcgaccagcgtatagctgatatcgctcaggatattcagtaataagccaatcagggtaaagatataaagcgtgccgaacatcaccggatagtcgcgcgaaacggttgcttcataacccagcagccccaggccgttgagcgagaacatgacttcaattagcaacgagccggtgaaaaacatactgataaaagtggcgggaaacccggcgatcaccagcagcatggcgttacgaaaaacatgtttccagagaatgtttttttcactcacgcctttagcgcgagcggtaacgacatactgtttacgcacctcgtcgagaaacgaatttttcgtcagcatcgtcagggcggcaaaaccgccgatgacggtcgccaacaccggcagcgtaatatgccacaaataatcggtgattttctggtaccacggtaacgtgtcaaagttggcggagaccaggccacgtagcggaaagatatcgtagtagctgccgccggcaaaaaagacgattaataaaatagcgaacagaaaggcggggatcgcataaccaataatgataaacgcgctgctccacacatcaaagcgactgccgttatggacggctttgcgaatccccagcgggatagacaccagataaataatcagcgtgctccataatcccagggtaatggagacgggaaggctatctttgatcagcgttagtacggatgcgctgcgaaacagactgtcgccgaagtcaaaagagagatagtcccgtagcatcttgaaataacgctcatgcagcggtttgtcgaagccgtagcgatgggtgatctccgtgatcacctccggatcgagtccccggccgccgcgataatggctgtcgctgatattgccgacgccggtttgcgcatgactggcgcgaacgccttcgccgctggcgccgggcaacgcgccgccctgaccaaattcaatcgcggcaatagcctgatcgacagggccgccgggagcgatctgcacgataaaaaagttaatggtaataatggcccatagcgtggggatcaccagtaacagacggcggataagataggcacccattgattcttactacctcctggctgccggtagcttggcggctttgttgacatcataccaccaggtatctaacccgatggtatataccgggcgaatcgccggatgggagaatttatcccaccaggcgagcctgtcttgcgccatataccacatcggcagcatgtaatagttccaggtcagcacgcgatccagcgcccgtcccagcggcaccagtttcgctttatcaccctgcgctgcgataatttgcgcgatcagcttatccaccaccgggctttgtacgccgggagcgttataactggagtcaatgtattccgacgcccatgagatttgtagatcggagctgggccagggcatcgcccgccatagcctcggcatcatgtcatagtcgcggctacgcatccggttggtgagttgagaattatcaacctgacggatagtcatcgtaatgcccagacgctgaagattatgctggaagggcagaacccactggctattactgctggcaggaaggagaagttcaaacgtcagaggcttaccggtgacgctattgacccgttgctgtccgttgatcacccatccggcctgcgtcaacaaggcgtcagctttaagaagattttcgcgatcgtagccgtcgccgttagagaccggcggctgatagatctgagtgaagacttcaggaggaagatcttttttcatcggcgcgagtaataccagttcgtcggcgtcaggataatttctggcggcgtactcggtattctggaagtaactgttggttcggctccaggcattatagaacagcgctttattcatccactcaaaatcgaaggccagggtgacggcttcacgtacccgccggtctttaaataccgggcgctgaatattaaaggccagccagcgtgtgtcctgcgccgactcgtttttctgctcttctttaatgatgtaatgattatcgaaatttttaccgatatagcgcgttgcccagtttttagcgtcgttttccagccgtagatcaaatgcgcccgctttaaacgcctcgaaagcgacattgtcatcaaggtagtaatcgtagcggacagtgtcgaggttaaaacgtccacgattgaccggcagattagccgcccagtagtttttgacgcgtgaatagacaatgtactggcccattttccactgagtaatccggtatggcccgctggctaagggcggcgttgaaagtggatcgctgagtttgtgatttttccagaatttttcgggcatgatcggtagtgaaaacagactaagcatgtcttctttaccaggcttcgccagctcaattcgcacggttaaaggcgcaatcgccttcacggtagtacctttatagaccagacggaactgcggtacgccttcggtcataaacttatgaaaggtaaaggctacatcgcgggcggtaatgggcgtgccatcgtgaaaacgagcgcgggggttaatcgagatttccacccaggaatagtcggcggcatagcgggcatggtcggcaatcagcgggtaatagcttccgggttcatcatccgaggtggtaaaaagcgtatcgtaaagggcttcggtacgtacgccgggattgccgcgcagcgaatagcgattgaaattatcgaacgtaccaatggcggaaagcgtcatctgaccgcctttcggcgcagcaggattcacataatcaaagtgatcaaagttaaaagcatacttaggttcgccgagtacggcgaaagcgtagctttctttgatttcctgggcctgggcgccagcgctaaccagtgcgacaagcagaagcattacgcgcgcaatcatctgaaggcggtttccttatcgtattgcccgctgcaaaccggcaggcgtttcgctgaataataagtgacgttgcgtctgatgtgaatccgttaaaaccgtaaggggactaccattcaggcacggaaggcgccgacatccacagcacgaaatcttttaggggtaaaggacggctaatccagtacccctgcaagtaattaacaccgtgatcgcgtagccaacgggcctgctccggcgtttcaacgtcctcggccaccgtcagcatattcaggcgtctggagagcgtcagcacggtatccagaaccggagacgtgacggtttccgtgccgatcgcctggataaagccgcgatcaattttcagataatctaaagtaaatcgctccagataaatcagggcgctatggcctgtaccgaaatcatctatagcgatttcaaacccggcggaatgcagccattcgaacagtttggccgcttcatactgctgaagcatattgcgttcagtgatttccagcacgatatgaaaatggtgcgcgggcagggcgtccctgagccggtgcatatcctctttaaaactgtcgctgtgcagatgttccggcgcgatgttaatgccaaatttggcaccgacgggcatcaccttctgtagcgtgggtgcgtcgcgggcgatcagctcgaacagatgctgcgttaacggtacgataagttgctgcgcttcggcatagtggataaaggcatccggcggaatctcgcctgccgtagggtgacgccagcgcagtaagacttcaagcccggtgacgcttagcgtacgagtatcgacgacgggctgataaaccacataaaactgctcgtgtttgatcgccgttaaaatctctttgcccggtcgcgtccggagggcatagataaagtaacagataaaccccgctacgatgccgctaatgcagcccagcatcaacgcataccacaagtcattgtaggtccagctatcggcataaagctgtattttaagcggcaggccgttgatagttgcctgtcgtgaaggcgtgcccggcagctccgcgacggtcagcagacgcgaagaaaaggtcgacagcgcggtattgccgacaatcagcgcgatgccgttaaaatcgtcctggcgcgtggtatagagtaagtagggcgtcaggttaatattcagcgatgtgaatacgccgctgttatttaataatgggtttcgataccaaatcaccattgtcggtttgttgggcatcattggcgtgccgggcagaatcgccatagcaacgtctttgcggatatctatatccggtaccagttgctgaagcggcatattcatggcgccagtggcggaagagcagaacacttttttatctttaatcaataagaaggcgcggacattaaggctaaaagcggctcttgaggtgagttctgcgccaacctgctgacaggtgttgatcgtcaacggctgaagaatatcggtggtggctttcaggtcggcgaaatagctggctaggtaatgttgtacatcagaaaggagcgtattgtatttaacatcccgtttatgccacgacaggaaaaattgcaggctaccaataagtaatgctgccgctatccccgtaatgatacaggtaagcaggattttccgaccggaagaggagtcgcgtgtaagcataattcctggtgtgacctgaaaaggcagatgccggttaaactggttgatttataagactatagcctggattaccccggatagtcatgcttttctgtgatgcgcaggaaagcgtattgtcgcagtagtcgttggcggaaacgacctgaatgtctgatggcgctatgtttatcaggcctatgttcgtgtgttgtaggctggataagaggcgacacgtcgctattcggtaaaacgggttcagaagggataataagcaaaagcactgctgaagcagtgctttttatgtcgtctcatcaggtaagccaagggaggtgctgcctgatgaagattaactgcggctcagaactcgacgcgcttcattgtagcgttttttccagtacggttcgttcatactggagataatgacgccgctactggtagacgcatggacaaattggttattgccgatataaataccgacatgacggccagtggaaccggcgcggaacagaaccagatcgcccgtacgcaggttattgcgtgaaaccgctttgcccatttcctgctgttcataggttgaacgcggaagctctaaaccaaactgttcgcggaaggtgcgctgtacaaagctggaacagtcgacgcctttcttagtgctgccgcccaggcggtaacgcacacctttccagtcagcatactgatccataatccgcgacttaacgtcgaggttacgcaccatattttcaaattcatcctgagaggcttgcagtgaagagctatcgctattgcccacagcatgcgtctcagaatgcatattctttgcggtattggtggttgtgctacaagcagaaagcagaaccgcaactgcaatcgcaggaatcccgcgcaaaatatatctcaaaatcggttgagatttgaccatgttgtttgttttcccttgaagtccttaacgataaatatcgttataaaaatgccaaacgtgatgagactaattacctgcacagcttgagacaattctttgtgcacaaatctgtggcggaacgcacaaatttattcgcaatgagaataattatctggcgaggcaaaacgagtttgagattacccgattgttgctgtcattgcgagcgatttcgcgtgattttttataagaatttatgatacgaaaagtgagctatcagcacgggtcaaattaagcgcaaatcgtttaaaaatcgtgcaacctgttcattttgcagaggaataatattaccgaaaaatgatgggctgggggaatatcatcataaattaccttcaacgatgtaaaactatcgctgaaggcaatgttaattgtatgggttatttgtttaaaatttgtttatttccgcctgggagataatcctcaaaaagcgctatcgcccggtcgctgagcggggtcatcagccaccaggggaggccaatcaaaataaccgtgagcgacccaaccacaatatcggtgaaccagtgagcgccaatcataacgcgcggaaacgcgaaaaccacaaatataataagggcgataatccccgccgttttgccgaaataacgcagcataaaggcggaaaatatcagcagcatcataccgtgatcgcctgggaaactgtcttttgacgcgtcttttgtcgggatgtgcagcaactcgctgacgcgataaatatgctcaaaagagagcgttggactggcgcgcttgacggggatcagcgcctgaccgagttggttaagcaccaccgctgttagcagcatgaccaatccgattatcacaatgcgccgccggcccgacgcgtcttcttttagccagaaactgagcatcagtccgcccatcgccagcagcgaacagccgtcaaacgcccgattattggtaatagcgacccaccagaggaacgcgtggctttccaccagtttctggttaaagaagtggaatatgccggaatcaatggtgaaccagaaaccgtgattgacgggaagataccatgacaaaaacagcgccagaccggcggcattaagcagaattatcaaggaatagcgggttttcatcgtcatttcgccatagtttttaaacggtggcaaccttacgcgtgcgtcgctaaacgaagcttcaacaaggccgtctgtaacgtattccagtcggtttctgtgtttgagataagttcaacccggctatccggcggcgcgacactctgtgtttcgatgtgcaggtcatcgccctggcgattgatgcgtaccagcccctcttgtatgcgcataacgcctttcacccggcccaccggcgccagacgagcccattcgagtaggccaatggtgtcaaacacggtatcggcatcgaaaatccagccgcaggcctgatgaccctgtccgctattgaggctgcgtcgccagcgctgctgtgcgggcagatttagcgcggcgagtccttttttactggcatgagtgtgagaatgcgcggcgctggccggcagttccgccagattttgtcgcggtaaatccagaagcttaccgtctatctgtccatgttcggcatgaatcagttgacgatcgccgccgtactgtcgccaccactgttgcagggcggcatcgctctgcgccgtggcgcggtcggttttattggcgatgataatatcggctgaggcgagctgatcgcggaaattttcattggcgacgctctgttggtccagtagcaggcgagggtccaggatgcagagcgtggcgcgtaaatcaatccacggctcataaaccggcgcagttaataaatccagaatctgttttgggtgccccagtccggttggttcaatcagcaaccggtcaggtttgccctggcgcagcagcgtgttgagccccacctgcataggcaatccgttgacgcagcacatgcagccgccgggaatctcttttagcagtgcgccgctgtcggcaagcagcgcgccgtcaatacccacttcaccaaattcattaaccaggacggcccacttttcagccggatctttatgagctaataaatgaaggatagaggtggtttttccgctaccgagaaatccagtaataagattggttttggtcacgtcagctccagaatattgatacaacataacaacttttaataatcctggcgaataaacgtgaaaaagagaagtgctgagttgacgaagtcgtgcttctgccatcttaagagcagaaaatgttaaatttttaacgtttctcttgcctggtgcagaacagtcaataaataaaaggggcagactgcgccctggggcgcagccgaaaaatgtgaaacttaatccgcgcgccccatataacggcgctcttcgatatgaatgcggattttctcacctgcgctcaggtattcgggaacctgaatcaccagaccggtgcttaatgtcgcgggtttgttacgtgcgctggcggacgctcctttaatacccggtgcggtttcgacgatttccagatccacggtctgcggaagctctagcgccagcagttggccgtcccaggtcagaacctgcatatccggcattccgccttcaggcataaacagcaactcttcttcaatctgatctttggtgaaggtatacggcgtatagtcttctttatccatgaacacatattcgttgccatcgacataagaaaagtcaacgccgcgacggctcagggtgacggtatcaacgatatcgtcgcctttgaaacgttcttccactttcagaccggtgcggacatcggaaaagcgcattttatacagtgtggcggcgccacgggcggtaggcgactgaatgtcgatatctttcacaatcagcaatttgccgttgtagttcagtaccataccttttttgatttcgttcgctcttggcatcgaggagatcctgttgtagagattatctaaaatatcgcgtaaaactactcgcgccgggccgtccaggcaagtggaattgtcacttttgctggtgcaaaaaaggtgatactgttcgcccgctttccgctccgcgttcaacgagaatacgcgatggcatgtcgcctggaggggggaagtgtgctgtgttgtcccttctgtttccagccttgtcttcggaatgtctgaggacaggcctgatcatgatgacgtccacattttaaatctggatttttctttggacaaattctgttatctttcatttggttataaatagaggggctgagcatggactgtcgtagcggttgtggcgcttgctgtattgcgccttcaatttcgtcgccgatacccggaatgccgaatggcaagccgatgaataccagatgcgtgcagctttcggaagataacttgtgtcttatctttggctcgcctttacgcccaaaagtgtgctttggtttgcaaccgacaggggacatgtgtttaacgacccgggaagaggccattatttatttgctggaactcgaacagaaaaccttaccatgagctaatagcctaatgggataggctctaagtcagctgtttttgataaacgtgcaggggcttacgttatatcccgaaatagtctgcaaaagctgcgcatcaaattacctccttttaccattaaatagcgtaatacatgcttcccttatttcgtgtcttctgaaacggtagatgtcgccgctcaaccccgttggtgcctgaacgtgtaccgaacaaaccgtcacataaaacaaaagcgatcaattttatttatatgatagtttttatctattaaaaagaggaattttgatcgattttaattatttataacgatcgatatcattagtttgatagtttatatctatcattgatgtatttaccgatcgatataaccagtgtgaatgtgttgttattttcctttaaaatactcgaattcttatgtgtgggttttatcttatgaagaaatatacgttcgcagccagggcgtttatttttacgttggtgttgctttttgttatttcagtattcgggttgactattagcgttttaaaagggatgtgaaatgcggggagaaaatagtgaaattgatttagtcgacgtttccttattccttataagaaaatggctaagtatcgtgatcgctacctttatttttgtcgccattggctatgtttttgtgagcgtgcatcatgatacaaaggttgtgagtattacaatcaaacctaatctggatacgcctgctacctatgcgttatgtggctatgctaatgatattcaatgtaaaacaacggttatccttaaccagtttagccgtttcttgcctgcggaatataaaaataaaataagttttgacgcgaaaaatcagcttgtcctttttaaggcgcaggggagggaagaaagcgtcaataatattatttccaccctgaaaaatagcgtcgataaaatggcagcatggtatatcgatgatggtgacattaaacgttatagcgtgcataaaaatatgttacaaacggaaacatatacaaagctatccttgttgtcggaggcggttaaaaataatgctaacattgaagtgatagatgttgctgttacaccaaaatataagatgcggctggtgttggtcctttgcgggctgatgggcgtaattttctcaataaccggtctcttatgtaagagggcgctaacagaatatcgtattgagaaaaagacaatgaatgaccgcgcatgaacatcgcgcagaaataaattctgcgctgaaatgtgtcgaagagtaaaagtatcaggcttgcaagttaaacatctttaatacgcgccaggcagaacatggtggcgacaatcataactaacgcaaaccagaagaccgcatgataattccagatttctgcggcgattcccgccaacgaaccggcaatgatccagccgacgcgaatggtattggtatacagcgtggtggctgaacccgcctggcctggcatgagatcctgaaaatagagcatgccaatcccgccaagaatgccgatgtaaatcgcgttcagcaactgcaagccgagcaacgttgccggtgcgtgcgccagcaacatccccgcataaaagcacagtccggcgacaacggcgatgcacattaacaggcgttttcccaaccgtttggcgaagtaacctgcaatcagcattgtgggaatctccagcccggcggcggtgcccatcatcacgcctgcaagtttttccggaagatgcagctcattgatgataaacagcggcatattaatgatatacaggctgttagtcccccacattaacgtacagatgacaaacagcaacagcgtatcgcggcgattacgacgcggtgcttccagcgtgccggttgccagcggcgcatctttgcgcattgacggtaaaaagaaccacaccatgacgccgcagacgataaaagctaccgccgcgctcaaatacatcaccgtaaagctaaaacccatcgccagcgcataggccagcggcggcccaatgacccaggccaacgagacctgggcgcggaggattgagctgaacatcaccgcttcacgacctgtacgatcggcatgttctcgggccagcgcaaacatctgcgggttggcggtagagccgaagctactgagaaagacgccgatgaacagcaaaataaagtagttgcggttccaggcaaacaacacgcaggccaacatgcccagcacgcaacagaaaacgatcagttttttgcgatcgccttttttatctgagcgacccgccagaaactggctcacgataatgccgataaccgcgctgccggtaaaaaagaaacccaccatgccgggacgggcgtgaacctcatccgtcagaaaaatactgagtgtcggcgtctgtaacgcaccagcaataccggtgagaaaagcgacgatcaaaaaggcggtagacgtcaggtcaaacgatttgggcgcagcggcggcgggactgttgtgcatgtttctatatcagtggtgtgaagagaggcggagtttacgctgcccgtcagaaaataaacaggcgtctgaatcaaaatcgacacgaaaaatcaaaatagcattccagtttgttacaagggcgtgctgacgcaagctgaaagaaaaaagctgaagccttttatgcgtcagctattgagggtctgttggagaaaaaatgtgcttcacctcaaaaaattgctacaaaaccggtaacttttcttgcgtgctgaagcagaaagatccagactttcttgaaacgtttcagcgcgatctggtttttttgataactcagattggcgctttttttctcatagtggctgaatcgtttcaattcagcaggagaggagacacatgttccagttatcggttcaggacattcatccgggcgagcaggccggaaataaagaagaggccattcggcaaatcgccgctgcgttagcgcaggcggggaatgtggcgggcggctatgttgacggtatgctggcgcgcgaacagcaaacctcaacctttcttggcaatggtattgcgattccccatggtacaacagacacgcgcgatcaggtgctgaaaaccggcgtccaggtctttcaatttccgcagggcgttacctggggagaaggccaggtcgcctacgtggcgattggtattgccgccagttcggacgaacaccttggcctgctgcgtcagctgacgcatgtgctgagcgatgactccgtggctgaacagctgaaatccgcgacaacggcggaagagctgcgcgcattgctgatgggcgagaagcaaagtgaacaattaaaacttgataacgagacgatgacgctggatgtcatcgccagctcgctggtcacattgcaggcgctaaatgcggcgcgtctgaaagaggcgggagcggttgatgcggcgttcgtcgcaaaaacgattaacgatagtccgatgaatctgggacaaggcatctggctgaacgacagcgcggaaggcaatttgcgcagtgctgttgcggtaagccgcgcgacccaggcgtttgacgtagagggtgaaaaagcagccttattagtcactgtcgcgatgaacgacgagcagccgattgccgtgctaaaacgcctcggcgacctgttgctgaacaataaagccgatcgtctgctgagcgctgacgccgcgacgctgctggcgttgctgaccagtgatgatgcgctgacggatgacgtactgagcgcggaatttgtagtgcgtaatgagcatggtctccatgcccgtccgggcaccatgctggtgaatacgattaaacaatttaacagtgaaattaccgtgacaaaccttgatggaaccggcaaaccggcaaacggacgtagtctgatgaaagtggtggcattaggcgtgaagaaaggccatcgtctgcgctttaccgcgcagggtgaagatgctgaacaggcgctgaaagcgattggcgatgcgatcgccgccggtcttggggagggcgcataatgagcaggcgtgtcgccaccattacccttaatccggcttacgatctggttgggttttgccctgaaatcgaacgcggcgaagtgaacctggtgaaaaccacgggtctgcacgcggcgggcaaaggcattaacgttgccaaagtgctgaaagacttaggcatcgacgtcactgtcggcggttttctcggtaaagataaccaggacggttttcagcaattattcagcgaactgggtatcgctaaccgctttcaggtggttcagggccggacccgcatcaacgtgaagctgacggaaaaagatggcgaagtgaccgacttcaacttttccggctttgacgtgactcccgcagactgggaacgctttgttaacgactccctgagctggctgggtcagttcgatatggtctgcgtcagcggtagcttaccggctggcgtgagtccggaagcgttcaccgactggatgacgcgtctgcgcagccagtgtccatgcattatctttgatagtagccgtgaagcgttagtcgccggtcttaaagctgcgccgtggctggtgaaaccgaatcgccgcgaactggaaatttgggcgggtcgtaagctcccggaaatgaaagatgtgattgatgcggcgcacgcgttacgcgaacagggtatcgctcatgtggtgatttcgctgggggcggaaggcgcgctgtgggttaacgcctcaggagaatggatcgctaaaccaccggcggttgacgtggtaagtaccgtcggcgcaggcgattccatggttggcggattgatttacggcctgctgatgcgcgagtccagcgaacatacgctgcgtctggcgacggcggttgccgcgctggcggtcagccagagcaatgtgggtattaccgatcgtcctcagttggccgcaatgatggcgcgtgtcgacttacaaccgtttaactgacagcaggagaggcataatgaaaacgctgctgataattgacgctaatctcggccaggctcgcgcttacatggcgaaaaccctgcttggagcggcggcgcataaagcaaatctggaaattatcgacaatccgaatgatgctgaactggcgatcgtgctgggcgaatctctgccgaacgacaatgctttgaacggcaaaaaggtttggctgggggatattggtcgcgccgtcgcgcatccggaactgtttctgagtgaagccaaaagccatgcgaccccttacagcgcccctgctgcggctgctcctgcagcgagcggcggtccgaaacgcgtggtcgcggtaacggcctgcccgaccggcgtcgcccatacttttatggcggctgaagccattgaaacagaagcgaaaaaacgcggctggtgggtaaaagtcgaaacgcgcggctccgtgggggccggcaatgccatcaccccggaagaggtggcggaagcggatttagtgattgtggcggcggatatcgaagtggatctggcgaagtttgccggtctcccgatgtatcgcacgtcgaccggcctggcgctgaaaaagacggcgcaggagctggataaagccgtagcggaagcgacgccgtatcaaccggcgggtaaggcatcgcaagcggcgaccgaagggaagaaagagagcgctggcgcataccggcatctgttgacgggcgtttcttacatgctgcctatggtggttgccgggggactgtgtattgcgctttccttcgcctttggtattgaagcctttaaggtgccggacacgctggcggcggcgctgatgcagattggcggcggttcggcgtttgcgctgatggtgccggtactggcgggttatatcgctttctccatcgcggatcgccctggccttacgccaggtctgattggcggtatgctggcggttagcaccggttccggttttatcggcgggatcattgccggcttccttgccgggtatatggcgaagcttatcagtaccaaactgaaacttccgcaaagtatggaagcgctgaagccaatcctgatcatcccgttaatttccagtctggtggtggggctggcgatgatttacctgatcggtaaaccggttgccgggattctggaagggctcacccactggctgcaaaccatggggacggcaaacgcggtgctgttgggcgcgattctcggcgggatgatgtgtaccgacatgggcggcccggtgaacaaagcggcgtatgcgtttggcgttggtctgctgagtacgcaaacttacgcgccgatggcggcgatcatggccgcaggtatggtaccgccgttagcgctgggtctggcgacgatggtggcgcgtcgtaagttcgacaaagcgcagcaggaaggcggtaaagcggcgttggtgctggggctgtgctttatcactgaaggcgctattccgtttgcggcgcgcgacccgatgcgtgtactgccgtgctgtatcgttggcggcgcgttgaccggggctatttctatggcggtaggcgcaaaattgatggcgccgcatggcggtctgtttgttctgcttatcccaggcgcaattacgccggtattgggatacctgctggcaattgtggccggtacgctggtggcaggactggcttatgccgtcctgaaacgtccggagacggaagtcgcggcaaaagcggcataagagaaacacgctaaaaaaggcagagcgcgctctgccttttttattgcctgaagaacattgagcgtcaggccatcgcttcggcaatttgctgggcttttaaccacgcaatctcttccgcccagatatcaggattgatggtctccagtatcagcggaataccgtcaaaacgcgcatcctgcataatccaacgaaacgcatcgtggccgatattgccttcacccagactgtgatggcggtcaacgcggctaccgaaggcgcttttggcgtcgttaaggtgcattccgcgcaaatactgaaatccgacaattttcccgaattcggcgaacgttttttcgcacgcctctggcgtacgcagatcgtatccagcggcaaaggcatggcaggtatcgatacagacgccaacgcgcgacttatcttccacgccgtcgatgatggcggctaactgttcaaactcaaaccccagattactgccctgaccggctgtattttcgataaccgccgtaacgccctcggtctgcgcgagggcaatattgatagattccgcgatccgcgccaggcaattctcctgtgcaatctgcatcagatggctaccgggatgaaaattaagcaaggttaagccgagttgttcacagcgctgcatttcatcgagaaaggcatcgcgtgatttttccagcgcttcactgaccggatggcccagattaatcaggtaactatcgtggggaaggatttgcgccgccgagaaatgatacttttcacaggcgattttaaagtcatcaatgacctggggagtaaggggggcggcacgccactgacgctggttttttgtgaaaagcgcaaaggccgttgcgccaatttcagccgcgcgggcaggggcgttagccagaccgccagcagcgctgacgtgcgctccgatgtatttcataaaagactcctgttaaacccgctaacggttcattacgaacgctatgataacgggttaacaggcgtgaaacgtaataatttatgcgataaggctatggattaggacgttaatggcgccaccgccaataatcagccaggcgaataatgccagcgccatcagcagcggtttcgcccccgcttttttcaatgcgctaacgtgagtggtcagacccaacgccgccattgccatcgccagcagtaccgtgtccagcgtcaccagcatatccaccacggctttcggcagcaggtggaaagagttgaagatcgccactacgatgaagaaaatagcaaaccacggaatggtaattttgcttttttccgcgccggtcgccggggaaagctgtttaacgcgtgccgccagaatgatcaggaacggcgccagcatcatgacacgcagcatcttagcgataactgccgcattttccgcatccgggctaacggcgtgacccgctgcgaccacttgcgcgacttcatgcatggttgagccgatatagatgccgtaagtttccgggctgaaccagtgcgccagcagcggatacattgccgggtaaaggaaaatagcgatggtgccgaaaataacgacagtcgcgacggctacagtaaccttactggcttccgcttttaccaccggttctgtcgccagtaccgccgccgcgccgcagatactgctaccggcgccaatcagccagctggtatgcctgtccagaccaaagactttttggcctaagaagcaggccagcatgaacgtgctggaaagcgttaatacgtcaatcacaataccgctaatacccacgtcggcgatttgtgaaaaggtaaggcggaagccgtaaaggataatccctaaacgcagtaaatgttgttttgcaaacagcacgccgccgtcgcattgtttccatatttgtggatagacggtattcccgataaccatacccagcaggatagccagggtcagggcgctgaaccccgcgcctgcaacagcagggatagcgccgccccacagggcgactcctgtaatgacggcgctcagagcgagccccggtataaaatgccacattgtacgacgatgattctgcaaggtgagttctgtcataaccttctcctgtatatggacaataaggttacggtgatctggtttaaaaataaaattgattatatatttataattaatctttataagtggtaagtgaaacgctatcggtgggatacgactatgcatattacgctacgacaacttgaagtgtttgctgaagtactgaaaagcggttcaacaacccaggcgtcggtcatgctgtcattatcgcagtccgccgttagcgccgcgctcaccgatctggaaggtcagctcggcgtacagttgtttgatcgggtggggaaacggctggtggtcaacgaacatgggcgcttgttatacccgcgcgcgctggcattgctggagcaagcggtagaaattgagcagctatttcgtgaagataacggcgcgatacgggtttatgccagtagcaccatcggcaattacattttacccgccatgattgcccgctatcgccagcattatccggccttgccgctggaactcagcgtgggaaacagccaggacgtgattaacgcggtgttggattttcgggttgatatcggcctgattgaagggccgtgtcacagtacagagattatctctgagccgtggctggaagatgagctggtggtctttgccgcgccgtcctcgccgctgacgcaggggccggtgacgctggaacagcttgcggcatccccatggattttacgcgagcgcggttccggtacgcgggaaattgtcgattatttgctgttgtcgcatttgccgcgctttcatatggcgatggagttggggaattcagaagcgatcaaacatgcggtgcgtcatggactggggataagctgtttatcgcgccgggtgattgctgaacaacttcaggcgggaaccctgggcgaagtcgcggtgccgttaccgcgcctggtgcgcacgttgtggcgtgttcatcatcggcagaaacatctttctaacgcgttgcagcgttttttgagttactgtgaataaaggtgaagaggagggctgcccgagcggcatcgccatttttagtatccgcttacgtatacgttattctctgctttacttataatccgtggccggtcatgaaggtctcttataaccgcgcatttgtgtcggaaggatagtatttcgtctgttacaatcgcgcctcattttttggatggatagcattttcacatgggttccaaaactaaaaccacagaagcgcccgcgctacgtcgcgaattaaaggcgcgtcacctgacgatgattgccattggcggctccatcgggacaggtcttttcgttgcatctggtgcgacaatttctctggcggggccaggcggcgcgctgttttcttatattctgattggtttgatggtctacttcctgatgaccagtcttggcgagctggcggcctatatgccggtatctggctcgtttgcgacatatggtcagaactatgtggaagaaggctttggtttcgcgctgggctggaactactggtacaactgggcggtgactatcgctgttgacctggttgccgcacaattggtgatgggctggtggttcccggacacgccgggctggatctggagcgcgctattcctctgcgtcattttcttgctgaactacatttctgtacgcggttttggcgaggcggagtactggttctcgttaattaaagtcgcgaccgttattatcttcatcatcgttggcgtagcgatgattatcggcatctttaaaggtgtcgagccggtcggctggagcaactggacgacgggcgatgcgcctttcgctggcggttttgcggcaatgattggcgtcgcgatgatcgtgggcttctctttccagggaactgagctgattggtattgccgccggggaatctgaaaacccggagaagaatattccgcgcgcggtgcgtcaggtgttctggcgtattctgctgttttatgttttcgcgattttgattatcagcctgatcattccttataccgatccaaacctgctgcgtaacgacgtcaaagacattagcgtcagtccgtttaccttagtgttccagcatgcgggcttgttgtctgcggcggcgataatgaatgcggttatcctgacggcggtactgtctgcgggtaactccgggatgtatgcctcgacccgtatgctctacaccctggcctgtgacggtaaggccccgcgtatttttgcgaaattgtcccgcggcggcgtatcgcgcaatgcgctttatgccaccaccgtgattgccggtctttgctttttgacctcaatgttcggcaaccagacggtctatctgtggctgttgaacacctccggtatgacgggcttcatcgcctggctggggattgccattagccattatcgcttccgtcgcggttacgtgttacaagggtatgatgtgaatgatttgccgtaccgttccgggttcttcccgctggggccgattttcgcctttgtactgtgcctgattattacgttggggcagaactatgaagcgttcctgaaagataccatcgactggggcggcgtcgcggcgacctatatcggtattccgctgttcctgcttatctggttcggctacaagctgataaaaggcacgcatttcgtgcgctatagcgaaatgcacttcccggaacgcgttaaaaagtaacgtaatattctcgtcataggccggataaggctttatgccgccatccggcacggactgcctgaacctgacccttctaaccctctcattcgagagggttttttgttttttctttatgattggttcaaatgacataattattaacaattaaattgataattattatcgtttactttatcgttacgctcgaaatcagaaaggatgaagattcgggcgcgaccgtcactcatgagcccgactcgcctgcataaaaagagttcgccgtgataaccgttatcgcaggcgaaacgtaatgcgttgtgagcgataaccgatttttttgtcgtatttacctcatggagaaatggaatgtttaggtttaaccctttcgttcgggtagggctttgtatgtccgcagttacgttggcctggccggttgccgcggcaacggatgatggtgaaaccatggtcgttaccgcgtccgccatcgaacaaaatctgaaagatgcgccagcaagtatcagcgtcattacccagcaagatttacagcgcaggcccgtgcaaaacctgaaagatgtcctgaaagaggtgccgggcgtacagctcactaacgaaggggataaccgtaaaggcgtgagtattcgtggtctggacagcagttatacgctgatcctgatcgacggtaagcgcgttaactcccgtaacgcggtcttccgccataatgattttgatctgaactggataccggttgacgctatcgaacgcattgaagtggtgcgtggccccatgtcctcgctgtatggctccgatgcgctgggcggcgtggtcaacattatcaccaaaaaaattggtcagaaatggcacggcagcgtcacggttgactccactattcaggaacatcgcgaccgtggcgatacctataacggtcagttctttaccagcggtccgctgatcgacggcgtgctgggaatgaaagcctacggtagcctggcgaaacgcgaaaaagacgagcagcagagttccgccaccaccgctacgggtgaaacgccgcgcattgaaggatttaccagccgggatggaaacgtcgagtttgcctggacaccaaacgaaaatcatgacgttaccgcaggctacggttttgatcgccaggaccgggactccgactcgctggataaaaaccgactggaacggcaaaactacgcgttgagccataacggacgttgggatctcggcaatagcgagctcaagttctacggcgaaaaggtggaaaacaaaaaccccggcaacagtagccctatcacgtcagaaagcaattcgattgacgggaaatacgttctgccgttagcgtctgtcaaccagttcctcaccttcggcggcgaatggcgtcacgataaactgagtgatgcggtgagcctgaccggcggttccagtactaaaacctccgccagccagtacgctctgttccttgaagatgagtggcgcatcttcgaaccgctggcgctgaccaccggtattcgtatggatgaccatgaaacctatggcgatcactggagcccgcgtgcttatctggtctataacgcaacggataccctgacggtgaaaggtgggtgggccacggcctttaaagcgccgtcgctattgcaattaagtccggactgggcgaccaactcctgccgtggcggatgccgcattgtcggtagcccggatctgaaacctgaaactagtgaaagctgggagctcggcctttattaccggggcgaagaaggcatactggagggcgtggaagcgagcgttaccacgttccgtaacgatgtggacaatcgcatcagcattagccgtacccctgacgttaacgccgcgcccggctattccaactttgtcggcttcgaaaccaacagtcggggacagcgcgttccggtcttccgttattacaacgtgaataaagcacgtattcagggtgtggaaaccgagttgaaagttccgtttaacgaggcgtggaaactgtcgttgaattacacctataacgacggacgcgatgtcagtaatggcgggaacaagccgctttccgatctgccgttccacaccgcgaacggtacgcttgactggaaaccggcgcagcttgaagactggtcattctacgtatcagggaattataccggacgtaagcgggccgacagcgcaacggcgaaaacgccgggcgggtacgtggtctgggataccggcgcggcatggcaggcgacgaaaaacgttaaactgcgtgcgggcgttctgaacgtgggcgataaagatctcaaacgcgacgactacggttataccgaagacggacgtcgttactttatggcggtggattaccgtttctgacagagactggcgacagccgcgttttgccgctgtcgccagaatgttataaccgatgcagcctggagagcagcgccagcgacagagtcgttagcagaatggcgattaacgcatagatataaacgcccgaccacgcccagctatttttcaccataattaccggcacaccggccattgccgcgccgacatagctgaacaatccccgaaagccggtaatcgatcccgccgcatccttatgggtcacatccagacagccgacggcaaaaagcatatgcggtccgtataaggcgaagcccatgatggtgaacagaatcgcgctgagggtgtaagaggtatcctgaaccagcggcaccagcacgatgcatatgcacagcgctaacgcgaagattaacccggtcatccagcggttacttttgaacataaagtcagacaagtagcctgccagcaacccacctgccagtccgcccgcctcaaatcaggaaataatcgagttcgcttttatcagactccagccgtgaacctgcgaatagtaaatctgcggccagtcgttaagaatagtgcgcgcaatataaaccgacatatcaccgataataatgatccataccagtggattggtcaggatatatttcacaaaaatctgccagaagctcaggttgaccgggctggccttgacctgggccagttccgtcgggtcgttacgccactgccccacgttgggcaaacctaacgtaccgggacgatctttaatggtaaatagcgtcactatccccatcagcagcgaaatggcgccgggaacataaaatcccattttccagctaccgctaaaggcgatagcaaaactggtcagcagcggcgcgaggctgccgccgatattgtgcgccgcttcaacgatagcccaccagcgtccccgttcgtttttcgaaaaccacgaggccataattttcgccatcggcggaaagctggtgccctgtaatatcgcgttgagactgtacagcacgtagaatgccgccacgctgtcggaaaagccgaacagaatatttacaatccccacgccaatcagcaccgggccggtcatggctttcgggttaattttatcgaccagcatcccgccgacaaacttcatcgcgccataaagaatgtaaaaaatagaagacataatggcgaagtcttctgcggtcagcgacgtttccgtcagcatggccggcatcgcggcggagaagtttttacgggtaagataaaagacggcataagagataaagaccgaggcgataatctcaaaacgaaattttttataggtctggtctatctcttttttctcttttacaatcggcttatcgggctggctgaaaataaatgtttttatactcattttaaaattcccttccggcgaggtgagtcgcgttataattcatcttcaataagaaaaagaagcaattcgaaaccgtgataattaatctgatggtggattttttcccgtacaaccggcttcgctttccaggcaataccggtgccagcatgttctaacatcggcagatcgttggcgccatcaccgcaggcaataatattctccgtggcaatatttaaccgggcagccaggtcaaccagcgtctgttttttgtttgcggcgttcataatcggcaaggtaatgttatccgtcagaacgttatcgcgtatttcaaccgtattcgaaaaggcataatccagttgataccgcgcttttagacgctgggtgaatatatccagtcccccggagataatcgcggttttaaatcctttggccttgatgactggcagaatagttaacaggcctggcgaaagggtcatgcgatcgcatacggcgttcagcactgctttcggtgtgcctttcaacattccgatacgtcgggtaaaactggcgttaaaatcaagcttgccctccatcgcctgttgggtaatggcggtgatttgcgtcgacatgccaagctcgcgggcaatttcatccacgccttcttccgcaataaatgtcgagtccatatcaaacgcgataataccgttagcaggcagtggctgcggcttaataaaaaaatcaaactgccattgcaatgagagttcgcgtaaatagcgataaaattcaggcgtcagacattccgctggcagcgtaagctttaaataagcggtattgataagcgcggcataacgtttatcaaataatagcggaaacggcatggtgacggcattaaataacgtttcctgtaattttttctgaaacgtatcgatatcctgtgtagtaataaaataaataatgctcatatgataactcccttaatttacgggtattataatggctcttttgcggcgtggaatctcgtgctatcacagatatcacagccagaaaagggctaaaaaagcgttgtttttgataccaggtaaagttcagacacaaaaggtatcacttttgatatgccaactgtgcgaggatgttatttattactgaacgcgaatgagactgaaaggattgatataacgatggagagttgccttgatatattcaaaatagtaataggtccatccagctcacgtaccgtagggccgatgcgcgccgcctgtcactttatttcattgctcagagaacaagagacgttgccgctaattcgggaaattgaaatcgagctgtatggcgcgttatcgttaagccgcaagtgccacaatgtggataccgccctgtatcttgggctgctgggttgccagccggagaatgtcgatctccgttcgcatatggcggtgattaagcgtgcggaaaatgaaaacaaaatcgaactcccgctctctgacgcgggcggaatcacgataaaagtcaagattatcgccaatcaccaggcgcatccaggccatccttatgccatgacgttttgcgccagggatgattattttacggtgtatgaagagacctggttttctaccggcgccgggcaggttcgtaaacatggcgagccgctgacgccatcgcttcctttgcgtacagtgtcgccctttgaatttagtcatgccgcgcagttgctggcgctgtgtcggcgtaacggcctgtccgtggcggcgctgatgatgaaaaatgagctgtgccgccactcgccacagacgttgcagaattatctggcgcaaatatgggacgtgatgcagcaggcggtttatcgcggcctgcatactgagggggtattacccggtccctatcaggtaccgcggcgcgcctgtgcgttacataagacgttacaggctaaccgctccgccagcgattttttaaccgcgctgaactgggtcaatgccttcgcgattgcggtaagcgaagaaaatgccagcggcggacagattgttaccgcgccaaccaacggcgcgtgcggcatcattccggcagcgctctgctggtatgataaatttgtcacgccgctggagcccggtgctctgacccgtttcttcctgaccgccgccgctatcgcgatgctgtttaaacaaaacgcctctattctgggatctgaagttggctgtcagggggaaatcggcgtggcgtgctcaatggcggcggcgggcctggctgaactgatgggtgcatccgtggagcaaacgctgagcgccgctgaaattgccatggaacatcatctgggattgacctgcgatccgctgggcgggcaggtacaaattccctgcatagagagaaatgccatctctgccgtgaaagcgataaacgcggcgacgatggcgatgagtcgcgtaagcgaaccctgtatttcgctcgatgagatcattgctgcgatgtacgagaccggtaaagacatgagcgctaaataccgtgaaacgtatcatggttcgctggggaaaattcagccgcgcaagagagggtaacagcgtgaaatacaatacgatgaataacgatgagattatcctgtcgttgtgcgcccgcttaaaggagacgcgtctgtctcttgcgatgacccagcagcagcttgccgatcgcgcgcacgttggcattgccaccatcaagcgtatcgagaaggggggagggctcaatcttgatacgctaatttctctcctgcgggcgctggataagttgcataatcttgatgcggtgctgtttgaatccgaactgcgtaattttcacgaaagttatgaaggcggagagggcagcggccgccttcaggtacgccagcaggccgcggatttaaataataaatcttccgcgccgcagtcggaggaggtgaactacagcgcggcgctggaaaattcattatgttggtgacgtctcatgctcgtcccgtaaataccgggcatgaaagcgcagatggtcctcaatgaaggacgcaataaaataatagctatgatcgtaaccgggctggattcgtagcgtcatcggccaggcggtttgccgcgcggcttccgccagtacggcgggctgaagctgatcggcgaggaattgatcgctgtcaccctgatcgatgagcacaggaatggcgtcctgcggctggctggccagcattaattcgcagctatcccactcagtccaggctgattcatcttcgccgagataagcggtaagcgctttgattccccacggcacgcggctggggttgacgatgggcgcaaaagcagagatgctggtgtatttgcccggatttttcagcgccatgattaacgcgccgtggccgcccatcgagtgcccgctgatggcgcaacggtcgctgacgttaaactgtgtctggataagcgccggaagctcatcgcgcaggtaatcgtacatgcgataatggctggcccagggcggctgtgtggcattgagataaaacccggcgccgtggcctaaatcgtatccgctatcgtcggcgacctgttcaccgcgtggactggtatccggcatcaccaatacaatgcccagttctgctgcgatacgctgcgcgcctgctttggtggtaaaattctcatcattgcaggtcaacccggacaaccagtacagtaccggaggcggttcattatcctgagtcggcggaagaaaaatgctgaatgtcatggcgcagtttagcgtggcggcatgatgacgccagcgctgctgccagccgccaaaacatcggtgctcttcgagcatttccatgcgggggctccttttatagtgaacctgataaggtatgcagattcttcataatacagattattcaccgcgttgtgagtaactttcacttccgtaatacataaacatgcttcatcatttaaataacgttgcgttaacaaatatgccctttgtcctgccagcattctcgcaccggaaaagatgtcatgaaaggcagcgacaatttcaacaattatgggcgtgaatactggattatgtgcgctacctcacgcacaataatcacactgtcacaatattgacaaactttgccccatgcagggcagaggcgccacacctgcaggagaacacgattaatgccatcactcagtaaagaagcggccctggttcatgacgcgctggttgcccgggggctggaaacgccgctgcgcccgcctatggatgaactggataatgaaacgcgaaaaagccttatcgcagggcatatgactgagattatgcagttgctgaatctcgatttgagcgatgacagtctgatggaaacgccgcatcgtatcgctaagatgtacgttgacgagatttttgctggcctcgactatgctaatttcccgaaaattaccctcattgaaaataaaatgaaggtggatgaaatggtcaccgtccgcgatatcacgctgaccagcacctgtgaacatcacttcgtgatcattgatggcaaagcgaccgtcgcgtatatccccaaagattccgtgatcggcctgtcgaaaattaaccgcatcgtgcaattcttcgcccagcgtccgcaggttcaggaacgtttgacccaacaaattctgacggcgctgcaaaccttgctcggcaccaataatgtagcggtatcgattgatgcggtgcattactgcgtgaaagcgcgcggtattcgtgacgcaaccagcgccacgacgacgacgtcgctgggcggattgtttaagtccagccagaatacgcgccaggagtttctgcgtgccgttcgccatcatccatgattaaggcggagacgatggagcgtaatgtcacgctggattttgtacgtggcgtcgctatcctcggtatcctgcttcttaacattagcgcctttggattgccgaaggcggcttatctcaatcccgcctggtacggcgcgatcgttcccgaagacgcctggtcctgggcgattctcgatattgtggcgcaggctaagtttcttacgctgttcgcgttgttgtttggcgcggggctacaaatgctgcttccgcgtggtaaacagtggattcagtcgcgcttaacgctattggtactgttaggttttatccatgcgttattcttttgggacggcgacattctgctggcctacggtctggtcggattaatttgctggcgactggtacgcgacgcgccttcggtaaaaagcctgttcaataccggcatactcctttatctggtcgggattggcgtactactgctgctgggtgtggtatcgagtagcgaaaccagccgcgcctggacgccggatgcgtcggcaatattgtatgaaaaatactggaagctgaacggcggcatggaggctatcagcaaccgggcagagatgctgtcaaatagtttactggcgctcggcgcgcagtatggctggcaactggcaggtatgatactgctgggcgccgcgctaatgcgtagcggctggctgaaaggccagtacagtctgcggcactatcgccgtaccggggttctgctggtggcgttagggctaatgatcaacctgcctgcggtcattttacaatggcggctggactgggcgtaccgctggtgcgccttcttattgcaggcgccgcgcgaactgagcgcgccgttgcaaacgctgggctatgccgcgctgatgtttggcttctggccgcagcttagccgatgcagactgacgcttgccattgcctgcgtagggcgaatggcgctgaccaattatttgctgcagacgatcatctgtaccacgctgttttatcagtttggcttatttatgaaattcaatcgactggaactcttgttctttgtcgttccggtatgggcaataaaccttctcttttccgtcatctggctacgtttctggcgacagggaccggtcgagtggttatggcgtcaactcacgttgcgcgcgtcaggatcgctcagataacgatctggatcacattcattaacaaaatggctgtaaccgtttccatccctgtgatgtttctcacgcagccctgggcagggtgctgacaaaatagccgcctgctaacggggcatttgtgagcatttttgaactcaaacagggcagtgaatatgatcaccattcgtgatgtagcgcgccaggctggcgtgtctgtagcgaccgtttcccgcgtactgaataacagcgcgttggtcagtcccgacacccgtgacgccgttatgcaggccgtcaccctgctgggatatcggccaaatgcgaatgcgcaagcgctggccactcaggtgagcgataccatcggcgtcgtagtcatggatgtttccgatgcctttttcggcgctctggtgaaagccgtagatctggtcgcgcagcagcaccagaaatatgttctcattggcaacagttatcatgaggcggaaaaagagcgccatgcgattgaagtcttgatccgtcagcgttgtaacgcattgattgttcactcaaaagccttaaccgatcgcgagctgagcgactttatggatcagatccccggtatggtgctgattaaccgtatcgtgccgggttatgcgcatcgttgtgtctgtctcgacaatgtgagcggcgccagaatggcgacccgaatgttgctgaataatggacatcaacgcatcggctacctggccttcagccaccgtattgaagatgacgcgatgcgcagagaagggtggttacacgcgctgcaagagcagggggttgctgcgtcggagagctggattggcaccggcacgccagatatgcagggcggcgagtcggcaatggttgagttgctgggacgcaatctgcaactgacggcggtatttgcctataacgataacatggcgtcgggcgcgctgacggcgttaaaagataacggcatcgccattcccttgcatctgtctgtcatcggtttcgatgatatccctattgctcgttataccgatcctcagttgactaccgtgcgctatcctattgcttctatggcgaaaatcgcgaccgagctggcgttacagggggccgcaggcacgctggatatcacggcgacgcactgcttcatgccgacgctggtacggcgccattcggtggcgtggcgacagaatgcggtactgatcactaactgattacgccccgcatgtaaccgttttcaatctgtgagtaaattcacagtttattaacattgtgatagctatgatgacaacgtttgtcgcactgtaactaatgtgtaacagttagttgttagttttgctggggtatttcgcttataaaaaccattatcacaatatcccgcgactaccggacaaaaataaagagttgaataagagcttatcccattagggctattttacttgccattttggacctgggcagtgctcgccaaaacgcgttagcgttttgaacgccgctagcagcggcccgaagggcgagcgtagcgagtcaaacctcacatactacgtgtacgctccggtttttgcgcgctgtccgtgtccaaactggctgcgccaataacgcctggtgggataggctctaaatacgcttcggcgttcagtaacatgcgttaacgtgctgaacagccgggcatttttttacgctataccctacataataaaaccggagctaccatgaataagaaggtactgaccctttctgccgtgatggcaagtctgttattcggcgcgcacgcacacgcggctgatactcgtattggcgtgacgatttataaatatgacgataactttatgtccgtggtgcgtaaggttattgaaaaagatggcaaatccgcgccggatgttcagctactgatgaatgactcgcaaaacgatcaatctaaacagaatgatcaaattgacgttttattggcgaaaggggttaaagctctggcgattaacctggtcgacccggcagccgccggtacggtgattgagaaagcgcgcgggcaaaatgtgccggtggtgttctttaacaaagagccttcccgcaaagcgctggacagctatgacaaggcgtattatgtcgggactgactctaaagaatccggtgtgattcagggcgacttgattgccaaacactggcaggcgaatcagggttgggatctgaataaagacggtaaaattcagtatgttctgctgaaaggcgagccggggcacccggatgctgaagcccgtacgacgtatgtggtgaaagagttaaatgataaaggtattcagaccgagcaactggcgttagacaccgctgtgtgggataccgcgcaggcaaaagataagatggatgcctggctgtctggcccgaacgctaacaagattgaggtggttatcgcgaataacgatgcgatggcgatgggcgcggtagaggcgctgaaagcgcataataaatcgtcgattccggtctttggcgtcgatgcgttaccggaagctttggcgctggtgaaatcgggcgcgatggccggtacggtactgaatgacgccaacaatcaggcgaaagcgacattcgatctggcgaaaaacctcgccgaaggcaagggcgcggctgacggcaccagctggaagattgagaacaaaatcgtgcgcgtgccttatgtcggcgtggacaaagacaatctgagcgaatttacccaaaaataacttttccgtctgtgggcgcaattttgttgcgccctgaaaccgtggaagggtgacgtgccgcagaccggataacgtatttcttttgccatccggcgcggatagtcataattaaaaaggccgacagggtatcattatgggcagcacgatctctccgtcgtcgggtgaatatttgttggaaatgcgtggcattaacaaatcatttcccggcgtgaaagcgcttgataatgtcaacttaaacgttcgtccgcactctattcatgcattaatgggcgaaaacggcgcaggcaaatcaacattattaaaatgtcttttcggtatttatcaaaaagactccggcagcattgtatttcagggaaaagaagtggacttccattcggcgaaagaagcgctggagaatgggatttcgatggtacaccaggagttaaacctggtattacaacgttcggtcatggataacatgtggctggggcgttatcccaccaaaggtatgtttgtcgaccaggataaaatgtaccaggataccaaagcgatatttgatgagctggatatcgatattgacccgcgcgcgcgtgggaacgttatccgtttcgcaaatgcagatgattgaaattgcgaaggcgttttcctataacgctaagatcgttattatggatgaaccgacctcatcgttaactgagaaagaggttaatcatctgttcaccattattcgcaagctgaaagaacgcggctgcggcattgtttatatctcgcataaaatggaagaaatttttcaattgtgcgatgaaattactatcttgcgcgacggtcagtggattgccacccagccgctggaagggctggatatggataagatcattgcgatgatggtcgggcgttccctgaaccagcgctttccggataaagaaaataagccgggcgacgtgattctggaggttcgtcacctgacctcgctgcgccagccttccattcgcgatgtctcctttgatttgcacaagggcgaaattctgggcattgccggtctggttggggcaaagcgtaccgatatcgtcgaaacgctgtttggcattcgtgagaagtcgtccgggacaatcactttacatggcaagaaaattaataatcacactgcgaacgaagcgattaaccacggttttgcgctggtgacggaagagcgtcgttccaccggaatttacgcctatctggatatcggatttaactcattaatttcgaatatccgtaattataaaaataaagtggggttactggataattcccggatgaaaagcgacacccaatgggtcattgattccatgcgggtaaaaacgccggggcatcgcgcgcaaattggttcactttccggcggcaatcagcaaaaggtgatcattggtcgctggctattaacgcagccggaaatattaatgctggacgaaccgacccgcggcattgatgtcggcgcaaaatttgaaatttatcagcttattgcggaactggcgaaaaaaggcaaggggatcatcattatatcttctgaaatgccggagctgttagggattaccgatcgtatcctggtgatgagtaacggtctcgtttccggcattgtcgatactaaaacaacaacgcaaaacgaaattttgcgtcttgcttctttgcacctttaagatcaggggctccttatgagtgcgttaaacaagaaaagctttttgacctggctgaaagagggcggaatttacgtcgttcttttagtgctgctggcgattattattttccaggacccgacttttttaagtttgctgaatttaagtaatattctgacgcaatcttcggtacgtattattatcgcgctgggcgtggcgggactcatcgtcacccaggggacagacctgtcggcggggcgtcaggtagggctggcggcggttgtggcggcaacattactgcaatcaatggaaaacgccaacaaagtgtttccggaaatggcgaccatgccgattgcgctggtcatcctgattgtctgcgcgattggcgcggtgattggcctggtgaacggcatcatcattgcttacctgaacgtgacgccgtttattaccacgcttggcacgatgattatcgtttatggaatcaactccctttactatgactttgtcggcgcttcgcccatttccggctttgacagcggcttttccacctttgcgcagggctttgtggcgatgggcagttttcggctctcctacatcaccttttacgctctgattgcggtagtgtttgtctgggtgctgtggaataagacccgctttggtaaaaacatttttgctattggcggcaacccggaagcggcgaaagtttctggcgtaaacgtggcgctgaacctgctgatgatttatgcgctctccggcgtgttttatgccttcggcggcttactggaagcagggcgtattggttctgccaccaacaacctcggctttatgtatgaactggatgcgattgccgcgtgcgtggtcgggggcgtatcgtttagcggcggagtggggacggtcttcggcgtggtgaccggcgtcattatctttaccgtcatcaactatggcctgacctatatcggggtaaacccgtactggcagtacattatcaaaggcggcattatcattttcgccgtggcgctggactcgctgaaatacgcgcgtaagaagtagttatccagacgtattaccttgcttatcagataacccggcgcagcgaaactgcgcgccgggcttcataccgtgagctacagcgttaacgcgtgttctttttcgccttttttaaatttgacctcgcctaaatcaatacaggcgaccgggcagacatgaccgcacagcagacaaccgacgcatttttccgtattgcaatgcggcgtgtggctgtgttcatcccactccatcgcctgatgaccgccgtcatagcaggagatatagcaacgtccgcagccgacgcatttctcctgattaatccgcggatagacgatatagctgcgatccaggtcttccgccgggataatattgccattcgccagcccgatcatctcctgtaatgaggcaaatccctgatcggccagatagtggctgaggccgctcgccatatcttctacaatgcggtaaccgtattgcataatgcctgtcgtcacctgtagggtcgccgcgcccagcagcagaaattcggcagcgtcttcccaggtttcaatgccgccgataccgctaatcgggaaatcgcgcagttcagggtgcattcgcaactgctggataaaacgcagcgcaatgggtttcaccgcttttcctgaataaccggagatgctggatttaccgttaaccaccggcatcccgattttgcggttcaggtcgatgttagtaatggatttcacggtgttgatggtggcgataccgtcggccccgccgcgtttggcggccagcgcgacttcacacatatcgccaatattcggcgtcattttcgccagcattggcaaagatgaaccgcgttttacggcgcggcagtatttttcaaccagttccgggctttgccctacatcgcttcccatggcgtgcgaggtcatctgcgggcaagagaagttacactcaatcatatccgcgccggcttcttcaaccagacgcgccagttcctgccactgctgctcattttcccccatgatggaagcaatcagcaccttatccggataatcctgttttagccgtcgaatggcggccagattctcttccagcggatgctcagcaatttgctccatgtttttgaaaccaataaaaccggtatcttctttcgtcaggtggtcaaaacgtggagagacttcgttggcaataaaaaaccaatggttttaaaaacgatcccgccccagccggtatcataggctttggcgcacatctcataacaattgcctaccggagaagaagaaaggcaaaacggattgggaaacttaacgccgcaaaaggtaacagacaaatcttttgttaacatgagcaggcctcctctaaataatgatgaatagcctgagcggcttcttttccggtttttaccgcataaacgacggtcttatcacctttaacaatatcgccagcggcaaagatcgccgggtcgtcggtttgataattgtgcgtgtcgataatattatgctgcgcttttatctccgcaaagttatccagtcgcgcgtgctgccccacggccaaaataatattttccgcttccagcgtcagttctcctgagtggcgtacatggtggaaggtcactttatttccgctgacggcgacaggcgtaaaaccatcaataatcgatacgcctaatgcctgcgtgctggtaaattctttttcgctggcggggaattcggctaattcttcccgcgccacgcaggtgacggaaggacagccgagaatttttaacgtactggcgacatccatcgctacgtcgccgccgccaataattaatgcgctacgcggaacgctaatatcgccgtcggcctgacgggcgcgctgtaaaaaatcaacggcaatctctacgtgactggcttgctcaaataacggtaaatcagagccacaggacatcccgacggtcatcagcacggcgcgatattcggctttgagttgcgcaagcgatagcgacccgcccacgtcacaattacatttaatattgacgcccatttctacaatgcgggcaatttcctgatcgagtacgctttgcggcagacgaaatgccgggatgccgtgacgcagccatccgccgggctgcggctgtttttcgtaaatggtgacgtcatagcctaaatgtgtgagcgtcacgcttgcctgcaaacctgccggacccgcgccaataatcgcgactttcccgcgtgttttactcccgggctgataaatctgcatggcagtctgctgttcaaaatcggtaataaaacgttgcaggcgtgcaatatcaataggtttatctattccggaacgtgtacatccgcgctggcataatttttccgtcggacagactctggcgcagacggcgccaagcgcattattttcccggatagtttccgctgcgcctttaaaattgcgaaagtaaatagaacgaataaatttccccggatcggtttgcgccgggcaagcctgactacagggcgcatcgtgacataataaacaacgggaagcctcttttattgccagtaatggcgtaaaaccaggcgtgagttcatccagataattttgttgcggcatataatcttccttaatgcttgaataaattaaggcgaaacgcaaataacgcgttttaatgatctaaaatctaccgccagcctaagcattgaaagaagggcattctgtgaaagaattcacaaaaaaatgaaaccagaatgcaaaacagcatttgttccttatatcataataataactattctcaattttaaagggataataaatagattaacgataaaaaagaagataaataatcattccagtaaataaaaaaccgcaaccggtataaagaaaaagataagaccaatattgtacgggatcggcatggcgataaacataaaccggttttcgcgcatttttgacaactttatctaccgcgtcggttcgccagcctttccaggcctcacgaaagcaaaaaagcgggagtagcagaaaggctaatatgacaaatatcgtctgtacatccatgatcatttcccttttttcttttccagttcaagcaattgttccggcgtaacggccggatacccctgggcgtcatttggcacctgatgctgcgtgggaataggtaccagcgggcctaaaaaacgcggttcgcgtttaaaaatatagagatccgccagcgcgctaaagcgggcgccaaattcgcgcaagcgtactgtcagcatatttttgggtgaaggtaccgcgtaacactgcgcctgaatgcccatatgcaacgcaataaacaaggcgcgttcgcagtggaagcgctgagtgatgataataaagtcgttgatatcaaacactttgcgggtacgcacaatggagtcaagcgtacggaagccagcgtaatcaagcacaatgtccgcaggatcgacgcccgccgcgataaggtctttgcgcatggtcatcggttcgttatagctttgcagggcattgtcgccgctgagcagcaggtaattgactttaccgctattgtaagcgtttaacgcgccctggatacgataacgatagtactgattaatgacacccttgcgatagtatttggctgtccctaacacgacgccaacctggcggtaggggagatcctgtagctcgtcatagatatagggcgctgttttccagctcatccaccgatcgaggccaagcaccgtcaacagcagcaagcttaccaggaccaacaggctgtaaaacacgcgctttaacatgcaggaaactcgataccaggatgaaagtacgatcaggctactgtacccgaagacgtagcgcaagaaaccgccgtctgattgcggagattttcagcatgatttcccttgtatcgggtcgcgggagaggagagtcaggccggataagacgccagtgcgtcgctatccggcacatttgcttagccgagaagcacgcggtcaatattatggcaacctaacgctttcagcgttgcggcggtggcatcccattgaattaatgccgcatcgcctttttccgccagaatcgcgcgctgaatatccgcatagtcatagtcattgagactcagcaggtttagcgcgccttgcagtgggggaagcgtagggttaaaggcggcgttttccgcatagctgccggtgaaaatacggccatctttacattccagcgccacgccgctcggtgagtggctataaggcatatggctcttattggctgccgtaatcgccgcttgcgttagcgtattgcccgttaacgtaaagccatgatcctgctcgtccatcagcagcgttttgatctccagatcttttggcccgaaagcgtcaggcagataatcgcgtaacgtatgcggcgcgcggcccggcagatgaatgcgcagatccagaccgctgttcagctcgttcataaactggcgacagtggccgcaaggcgtgtagttaacggtgacggcggcgagccctttttcgccgcgtagccaggcgtggctaatcgcgctttgttcagcatgcacagtttgttgcatggtggcgcccaggaactccatattcgcgccgaaataccagttgccgctaacgccgcgcgcaatcgcgccgacgttaaaatgggacaaatcggtacgggcgcaggccgccgccagaggtaacagtgcgaaagccagcgcgtcttcgtccagtcccgccgtatttttaagcgtcgagacctgctctgcggtcagcatggcgggaaaatggtggtccgccaggataggggccagcgctgattgcaaattatccgcaagctgggcaaaagcagtttgaaaacgtggatgcatggcgttgcctcataacaatgtaatggaaccgtagtttacgggcctgccatgtcttaatatgtgatctaaatctcattgcttatgcaacttgtgaaacttaaatgaaaaatacgcgacgtatcgcaaattttaacccggtcttttgtcccgtcgttagcgcattaccgccagaatgagcggaaacaaaaagggcgctaccagcgaggtaataatgccgcagatcaccagcgccagggagctaaacgcgccttcctggtaatccagctcggcgcagcgcgcagtaccgagcgcatgtgaggcggtccccattgccagcccgcgtgcggctttagtacggatgtgcatcgcgtttaacagcgtgtggccaaacaccgcgcccagaataccgacaaaaattacgcataccgcgctgatcgcggggatgccgccgatgctgccgcccaccgccatcgcgataggcgtagtcacggatttaggcagtaccgatgccgcgatttcaggcgttgcgcccatcagcaaggcaacggatgttccggtaatcatcgctaccagactgccgacaaaacagatgctaataatggatttccaacgcgcgcgaatctggtgcaactgttcataaaggggataggccagcgccaccaccgccggttgcagcagatcgttaagtacttcgctgcctttgaagtagtgctcgtagggaataccggtcagcaacagaaaaggaataatgactaccattgccaccagcagcggattcagcaacggcattttaaaatgcgccgccagtctgcgggcggcgaaaaataccgccagcgtcagcggtaacgaccaccagatatatgtcatcattttttcgttcccttctgcccaaccactttacgctcaccgtgtatcagatgtgaactccagcttacgaccacaaaaacgaccagcgtactgatagcgcaagagaccaccaccgggccgaattgcgcgcgcagtaagtcaaaatattgcatgaccccaacgccaattggcacaaacagcaatgccatataacgaatcagcacataacagccggggttaacccactttgccggcagaatttgcagcgccagcaatacaaacagaattaacatcccgataatgctgccgggaatagtgataggaagcagtgatgcaagaaaaatgcctgcgtacaaacaggcataaatcaatacaaaagcgcgtatatattgccagataatattcagtgacttactcatgtttaaagcccttgatgagatggattcatcatacaattaaacgttaaaacgtgctaccgatcacatcatgaattcttagcatagtgggtatagacagcaggaacatcgggcaatgcccctggtcggcggcgttaaacctgggctaaaaaatacaaaaagcgactcagggccaaagacggcgtctcattcttacgccagaacatccctacgctgcctttttgctcaatttttggcaagtttaaaatcgccagttgcccctggctggcatagcgttgcgccagccgtaaagaaagaatagagatcatatcgctgctttgcagcaaattggtgctgacgttcattgacgccgattcaatggtgttttccgggagcatgacgccattatcgacgagggcgttatcaatactgatgcgaataggggtgccggttggccagactatccaccgccagtgtgccagatcgctccaggcgatctgcgctcgcgcggccagcggatggtgcggacgcgccacaaagcagaccggctcggtataaagtacctgataattaagcggcagttgcagggcgcggccgccgacacgccctaccaccacatccacctgaccggcaagcaaatcgtgcagcagcggcgtcattaccttctcttcaatattcagatgcagcgtcggcatttcgttaagcaggctcagaatcgcctgtgatacgcagtcagtcgccacgggcgaacagccgatcttcaggctgccaaccaggccgccctgcttgaaacgggcgatttcatactgtgaacgctccagatcgttaattaggcgctgggcgtgctggagcagtaatttaccgccttccgaggggcgtagtcctttactgtggcgctcaaaaagcgtgatgcctatctcatcttcgagttgagatagccacttcgatagcgccggctgggagatattcatcatccgggcgacgtgcgtcaggttgccctgttcgcccagcgcaaccagcgtttgcaggtgatgtaatttcaatttctgcgcccagttcgccattcgctataacctccaggttatgtctctgcctgaaaagccattgtacattttatcgctcactctacaaactcgtaacatagcaaacataaaaacaacatctatctccctgcactgaggcattagctatgactcaacgacgtgatctacaagcccttattgatgccgcgcccgtcggcaaaatgcagtggcgcgttatcatctgctgttttctggtggttatgctcgacggtttcgacaccgccgcgattggcttcatcgccccggatattcgtactcactggcagctaagcgccagcgaacttgcgccgctgtttggcgcagggctgctggggcttacggccggcgcgctgctatgcgggccgctggcggatcgctttggccgcaagcgggtcattgagctttgcgtggcgctattcggcgcattgagcctgctttccgctttctcgccggatatagaaaccctggtgttgctgcgcttcttaaccggtctgggactgggcggagcgatgccgaataccatcaccatgacgtcggaataccttcccgctcgtcgacgcggagcgctggtcacgctgatgttctgcggttttaccctggggtcggcgatgggcgggattgtgagcgcgcaactggtgccgctgattggctggcacggaattctggcgctaggcggcatcttgcctttgatgctgtttttcggcctgctgttcgcgctgccggaatctccccgctggcaggtacgtcgccaactaccgcaagccgttgtcgcccggacggtcagcgccattaccggcgagcgctatcacgatacgcaattctttctgcatgagacggcagccgtcgccaaaggcagtattcgccagctttttgccgggcgacagcttgtcattaccctgatgttatgggtggtgttctttatgagcctgctcattatctatctgctttccagctggatgccgacgttacttaaccatcgaggtattgatctgcaacaggcgtcgtgggtgactgccgcattccaggtgggcggcacgcttggcgcgctgttactcggcgtgttgatggaccggcttaacccgttccgggtactggcggtgagctatgcgctgggcgcagtttgcattgtcatgataggcctgagcgaaaacggcctttggctgatggcgctggcgatttttggtaccggcatcggtattagcggttcccaggtcgggctgaatgctctgacggcgacgctgtaccccacccaaagccgggcgacgggcgtgagctggtcgaacgccattggacgctgcggggcgattgtcggttcgctctccggcggcatgatgatggccctcaatttctctttcgatacgttgttttttgtcattgctattccggcggctatcagcgcggtaatgcttaccctgctgacagtggttgtccgcctttcgatttctgtacctgacgacctgccgcgtgccagcgtcgtaaacgaataaggagaatctccatgtctgaaataaatcagaacgtaaaagatagccgtcagcagtattaccagcatatttccgggcagaatctgacgccgctgtgggaatcgttacatcacctggtaccgcagacgccaaacgccaactgcgcgccggcctactggaattatcaggaaattcgtccgctactgatggaaagcggcaatgtcattggcgcgaaagaggcgatccgccgggtgctggtgctggaaaatccggcattgcgcggtcagtcgtcgatcacggcgaccttatacgctggtttacagctgatcctgcccggcgaagtcgcgccgagtcatcgccataaccagtcggcgctgcgttttatcgtcgaaggtaaaggcgcatttaccgcggtggacggcgagcgcacgccaatgcataccggcgattttatcctgacgccgcagtggcgctggcacgatcatggtaatccgggatcagagccggtggtatggctggatggtctggatctgccgttagtcaatctcctgggctgtggttttgcggaagactatcccgaagatcagcagccggtgacgcgaaaagagggcgattatctgccgcgctatgcagcgaatatgctgccgctgcgccaccagcgcgggaactcgtcgccgattttcaactaccgttacgaccgcagtcgcgaggcgttgcacgatctgacccgtatgggcgatccggatgagtgggaaggctacaagctgcgttacgttaatcccgtcactggcggttatccgatgccgtcgatgggcgcgttcctgcaactgctgccaaaaggctttgcctcgcgtgtggcgcggagcaccgacagcactatctaccacgtcgttgaaggggcagggcaggtcactatcggcaacgaaacttttcatttttccgcaaaagacatttttgtggcgccgacctggcatgaggtgtcgtttcgcagcagcgaagacacggtgttattcagcttttcggacaagccggttcaggaagccctggggctgttccgcgaagcacgttattaattagggagagagaacatgaccaaatatgtattccagccgcaggccccggtgacagtacccgtggcgggcagtgatgagcagtttccggtacgtcgcgtttactgcgtgggtcgcaactatgccgcccatgcccgtgaaatgggttttgatcccgatcgcgaaccgccgttcttcttttgtaaaccagcggacgctgtcgtcccggtagcggcgggggataccctggaactgccgtatccggcgcagaccgataactaccattatgaaattgagctggtggtggcgattggtaaaaaggggagcgatatcccgctagaaaaagcccatgaatatgtctggggatacgccaccggtctggacatgacgcgtcgcgatcgtcagatggaaatgcgtcagatgggacgcccgtgggaaattggcaaagcgttcgatctctccgcgcccattgcgccattacacaaagccgctgaaacgcataatgtggataacgcccctatttggttacaggttaacggcgaagaccatcagcgcagcgatattcgtcatctgatttggtcggtgaatgaaaccatcagctatttgtccggcttttttgaattgcagccaggcgatttgattttcaccggtacgccagagggggtgggcgcagtggtgaaaggggatgtcatcaccgggaacgtagaaggtctgacgccgattgctgtgaaaattgtctgaggtgaacgatgaagctgtacagtttctttaatagttcggcgtcttatcgtgtacgtattgcgctggcgttaaaggggattgattaccagacagtgggcgtcaatattcgtatcggccagcagaatgcgctggcctaccgacggatgaatccggtaggcctggtgccgacgctagtcactgatgacggcgaatcgttggggcaatcgctggccatcgtcgactggctggaccgacattttccgcaaacgccgctgctgccgacgagcgacccggcgcgcagccaggcgctggaaattgtctacgctatcgcctgcgatatacacccgatcaataacatgcgcgtgttgcgctacctgaccgatgagctgaaggttagcgaagaggataaaaaacgctggtacgcccactggatacagcaagggttaagcgcggtagagcagctattgcgtaaaagtcagtccggacgattctgcgtgggcgacgcgccaggccttgcggactgctgcctgattcctcagtgggcgaatgcgctcaggatgggctgcgatttatcaggctatccgcgctgtaaagccgtttatgacgcctgcgtacagctaccggcgtttattgccgccgcgccggaaaatcaacaagataaaatcccggcctgaaaaggagaatgaccatgactcacgtgacaagcgcaattattgtaggtggcggaatcggcggcgcggcgaccgcgctgtcgctggcgcgccagggaataaaagtcatgctgctggaaaaagcgcacgaaattggcgagattggcgcgggtattcagcttgggccgaacgctttttcggcgctggatagtctcggtgtgggcgatgttgcccgccagcgtgcggtgtttaccgatcacattaccatgatggatgccgtgaatgccgaagaagtggtacgcattgaaaccgggcaggcgttccgcgaccattttggcgggccgtatgcggtaattcaccgggtagatattcatgcaacggtatgggaagcggtgctgacgcaccctggcgtggagtatcgtacctcgacccatattgtcgatatccgccagacgccggatgacgttacggtgtttgatgagcagggaaatagctggacggcggatattctcgtgggctgcgacggcgttaaatcggtcgtgcggcaaagtttactcggcgacgcgccgcgcgtaacggggcatgtagtctatcgggcggtgattgattgcgacgatatgccggacgatttacgtattaacgcaccggtgctgtgggcaggcccgcattgtcacctggtccattatccgctgcgcggaggccaacagtacaatctggtggtgacattccacagccgccagcaagaagagtggggcgtgaaagacggcagtaaagaagaggtgctctcttattttgccggtattcatccccgcccgcgtcagatgctggataagccgacctcctggcgccgctggtcgaccgccgatcgcgagccggtcgcaaaatggggaaccgagcgtatcactctggtgggcgacgccgcgcatccggtggcgcaatatatggcccagggcgcctgtatggcgctggaagacgccgtcacgctaggcaaagcgctggaacgctgcgacggcgacgcgcagcaggcatttgcgctgtatgagtcggtgcgtattccccgcacggcgcgtatcgtctggtctacccgcgagatggggcgtctctatcacgccgccggggtggagcgtcaggtgcgtaatctgctgtggaaagggaaatcgcaggaggcgttttatcgcggtatcgaatggctgtacggctggaaagaagataactgtcttgagccgcgttgagcgccttacgtgacgtagcgtggcgtttgcgccgccacccggcaaaaagttttgctcatcgcagagaggcgttatgatagcgcctctttttttgctgtggataccgatatgcgtgttttactggcgccgatggaaggcgtgctcgacgcgttagtgcgcgagctgctgaccgaagtgaatgattacgatctctgcatcaccgaatttgtgcgcgtggtggatcagctgctgccggtaaaagtgtttcatcgcatctgcccggagttgcttcacgccagccgcacgccgtccggcacgccggtgcgtattcagcttctgggccagcatccgcagtggctggcggaaaacgccgcgcgggcgacggcgttgggatcgtatggcgtggacctgaactgcggctgtccgtcaaaagtggtgaacggcagcggcggcggcgcgacattgctcacagatcccgaactcatctatcagggcgcgaaagcgatgcgggccgcggtaccgtcgcatctgccggtgacggtaaaagtgcgtctcggctgggatagcggcgatagaaaatttgaaatcgccgatgcggtgcagcaggccggcgccagtgaactggtggtgcatggccgtaccaaagcgcagggctaccgcgccgagcatatcgactggcaggcgatcggcgaaatacgccagcgtctgactattccggttatcgctaatggcgaaatctgggactggcagagcgcgcaggcatgtatggcgaccagcggctgcgatgcggtgatgattggccgcggggcgttaaatattcctaacctgagccgggtggtgaagtataacgaaccgcgtatgccgtggccggaagtggtaacgttattacaaaaatatacccgactggaaaagcagggcgataccggtttataccatgtcgcgcgtattaaacagtggttgggatatttacgtaaggaatatattgaggcgacagaactctttcagtcgattcgggcgttaaaccgttcgtccgagattgcgcgggtgattcaggctattaaaatctaatctctacagcgtccagaacgtgtgccgggcagatactatcgctgcccggcgcaggaatcagaaaatcatcttaaacacgcccgttaccaccaacagcccaatcagaaaaataattaagattgcccatagaagaattttcattgtttgtccctttattggtaaatacaaacaaagtataggaaagtattaagccatctgctgctttgttgggcgcggcgacgtttaactcatgaaggctgctggcgcgtattgcagcaaaatcgttcatttatgaacgggttagtgggacttttcattgaagtattacatcaaaaaatgtatcagatgaaattatttgctaatcatataaatttcaaaatatgtcttttgttgtctgatgatgtattgccacgcgtaactaaaaaatagttcgccgtaagacgtactctctgcgcacctttttttatcagaacacctccatgaatcgtaattctttccttgccgcgacagcgagcttaccgctttttattttgctggcgggctgcgcccctatgcacgatacccgccagtcgctgacccagcagacgccctcttctcatgttgattccagcctgccggcggcattgaaaaacggttggccggatagctagtggtggaaggcgtatcacgatgcgcagcttgacgcgctgattgataatgccatacagcattcgccggatatgcaggtggctgaacagcgtattcaactggcggaagcgcaggcgaaagcggttgaggcgcaggacggcccgcagctcgacttttctgccgacattgagcgccagcgaatgtccgcggaagggctgatggggccattcgcgattaccgaccccgcggcgggaacgaccgggccgtggtataccaacggtacattcggcctgacggcgggctgggatctggatttatgggggaaaaaccgcgctgaagttaccgcgcggatcggggcggtcaaagcgcgcgaagcggagcaggagcagacccgacaattgctggcaagcggcgtggcgcgactctactgggagtggcagacgcaggcggcgctgaaaaatgtgctgatgcaaatcgagcatgagcagcaaaacgtggtggcggtaaaccgggagctgtatcaacacggtattacttcttctgttgaaggggtcgagaccgatatcgacgccagcaaaacccagcagcagttgaatgacgttaacggtaaaatgaaggttattgaagcgcggctcagcgcgttaaccaatacgcaatcggcggcgctcaagctgcgtcaggtgagtctccccgccgttgaaagccagttaccgtcgcaactggggtattcgttgctggcgcgccgggcggatctacaggccgcgcactggtacattgaatcctcgttgagcagcattgacgccgcgaaggccgcgttttatcccgatatcaatctgatggcttttttacagcaggatgcgttacatctgagcgatctgttccgccattccgcacagcaatatggcattaccggcgggctgacgctgccgattttcgacagcggcaggctgaatgccaacctcgatatcgccaaagcgcaaagcaacctttctatcgccaactacaacaaagcggtggtagatgcggttaatgatgtggcgcgcgccgccagtcaggtagagacgctggcgcagaaaaatcagcatcagcagcagattgagcatgacgcgcagcgtgtggtcggtctggcgcaagcgcgctttaatgccggcattattgcgggttcccgcgtgagcgaggccaaaatcccggcactgcgcgagcagtgtaacggcttgctgttgcagggccagtggctggatgcctctattcagcttaccagcgcgctgggcggcggttatcattcctgatttttccagatgattcagacagggttcctatacttaggctgtgtatgattcatccggagaggaatatgaccaaagtcgcaattgtaacggcatcagattcgggaattggcaaagcgtgtgcgttgttattagcacaaaacggttttgatattggtatcacctggcattccgatgaacgcggcgcgcaggagacggcgaaaaaagcggcgcagtttggtgtgcgggcagagaccattcatcttgacctgagccagttacccgagggcgcgcaggccattgaacatcttatccagcgcctggggcgcgttgacgtgctggtcaataatgccggggcgatgaccaaatccgcgtttattgatatgccgtttacgcagtggcggcaaatttttaccgtggatgtcgatggcgcgtttctctgcgcgcagatcgccgcccggcatatgattaaacaaggagagggagggcgcattatcaacatcacctccgtccatgagcatacgccgcttccgcaagccagcgcctataccgcggcgaaacatgcgttggggggattgactaaatccatggcgctggaactgattgagcatcatattttggtcaacgccgtcgcgccaggcgctatcgccacgccgatgaatgatatggatgacagcgacattgagccgggatcggaaccctcgatccctatcgcccgaccgggttctacgcatgaaatagccagcctcgtcgcctggctgtgttcggaaggcgcaagctataccaccggtcagtcgctgattgtcgacggcggatttatgctggtgaatccgcaattcaacgcaaaataaacgccggggccggatggcggcgttatgccatccggataccatcgggtttaacgggcctccgctttgccgcgtcttttcagccaccagcgcacgcccaccaccaggacgatggccagaatcagccagactccgtgcctgagatgctgatcgaggtcgtgcagccatggcgcgatcacctcgccgccaagatatcccagcgtggtaaacagcagcgcccagatcagcgcgcctacaatattcagcggcagaaaaattttaggcggcaggcggctggcgccaatcagcagcgggccaaccacccggaagccatacataaaacgcgtgccgatcacaaacagatacggatggcgttggatcattttctgcgcgcgacgaatcttcgtatgataacgcgggaaacgacgcaggatcttcccgccatagcatcgtcctaacaggtaaagtagctgatcgcccatcatccctcccagcgcgacggccgccgccaccagcggaaacttgagtaatccctgatgcgccgcgacgccccccaacagggtaacggtttcaccttcggccatactgccgataaccagcgccgcatagccataatgcgtaataagcgtgttgatatccatgcgtaaaccacctccggcattaagcatacaccctggcaagaggcgtgcgcggcaaagccgacgttttgccggagactattttgccattgctcataaaataaccagaaactgaattatacttgaacatactggcatctgaggcagcagaagggggcagtatgaaccatgtatgggggcttttttcccatcccgatcgggaaatgcaggtgatcaaaagcgaaaacgaaaccgtttcgcatcactatacgcaccatgttttgctgatggcggcgattcccgtcgtctgcgcctttatcggcacgacgcaaatcggctggaattttggcgacggcaacgtgttacaactctcgctgtttaccgcttttgcgctggcggtcttgttctacggcgtgatgctggcgggcgtcgcggtgatgggacgcgtcatctggtggatggcgcgaaactatccgcaacggccatcgcttgcgcgctgtatggtttttgccggctatgtcgcgacgccgctgtttttaagtggtctggtggcgctctatcccctggtatggctatgcgctttggtcggcgctgtcgcgcttttttacaccggctatttgctgtatttgggtattccgactttccttaacattaatagagaggagggattaagcttctccagttcgacgctcgctatcggcgtactggtcctggaggtgctgctggcgatcaccgtgatcctgtggggatatggctaccgcctgttctgatgcgaaaaagggctggcgcaaaagccagcaatgcagcatttgctgacgattcttctgtagcggcaacgctggcgtgccgctatgatgccactgctagcttgagtataatcttagctcaggcggtgtgcgttacgacgcgcgtgaatcattatcagaaatctcatcatgctgaaattctgagcttcattcctgagccttgctctgatgttggccgttccttttgccccgcaggctgtggcgaaaacggcagcgacaaccgcggcgtctcaacctgagattgcctccggtagcgcaatgattgttgatctcaacaccaataaagtgatctattcgaaccacccggatctggtgcgtccgattgcctcgataaccaaattaatgacagcgatggtcgtgctcgacgcgcgattgccgctggatgaaatactgaaggtcgatatcagccagacgccggaaatgaaaggggtttactcccgcgtgcgcctgaacagcgaaattagccgcaaaaatatgttgctgctggcgttgatgtcatccgaaaaccgtgcggcggcaagcctggcgcactattatcccggcggttataacgcatttattaaagcgatgaatgcgaaggcgaaagcgctgggcatgacgcatacccgctttgttgagccgacggggctgtcgattcataacgtctcgaccgcgcgggatttaacaaaattgctgattgccacgaagcaatacccgctgattggccagctaagcaccacgcgcgaagatatggcgacattctcgcatccggcgtatacgctgccgtttcgcaataccaaccatttggtctaccgtgataactggaatatccagttaacgaaaaccggctttaccaatgcggcggggcattgcctggtgatgcgtaccgtgatcaataacaaaccggtcgcgctggtggtcatggacgcgttcggcaaatatacccactttgcggacgccagtcgcctgcgtacatggattgaaaccggtaaagtcatgcccgttccggctgccgcgctgagctataaaaagcaaaaagccgcgcaaatggcggcagccagcgccagcgccggagcgcaaaccgcacagaacgattaagtcgccgcaggcccggcaggcatcgcgccgccgggcattcacggtaaaccacaccgtgttaatgcgtttcgtcgggcgtattttcctgccagaatttccgcttactcgttttgccgataccggggttcatactgttggttgggtcattttgccgataaaaacgcgtcagcgtttccggcgctttatacagatgtccaacgttgtgctccgccgggtattgtgccccgcgcgcctgcaacagctccagcatttgcgctttcagcgcatggacgtcgacgcctttcttcacgatatagtcctgatgaaaaacgtggcacataaagtgaccgtaatagagtttatgtaccagttggctgtcgatttccggcggcagatgctcgaaccagtcggtatcgttgcggcgcagggcgatatccagcgccagaatatcttccacttcatcagcgtgtacggcctgataacgaatcgctgcgccagcagcggcgaagcggtgcaggaaggctttgctgccttcttccggcgtacaggtgaagaaaccgccctcagcggatttaaaaaattcattcagccagcgttgcgcttctgcgacgccgtctcccgccatttttaacagcagatgatgctcatatttatcgcgccagtttttcattcgcggcggcagatggctgggaaacagatggccgaatttctgcatcgcgcggtcggtgaaatgcggtcggaaaaattttactttttccagcatcgcatcggttcggccttttagcgtgaaaaagaatggcatcttgtcggtgccgagtttatcgatcatcagaaaggtatctttaccgtactgctccgcaatatcgtagatatcgcgatgcatatattctcccgccactggcagattgtcgaagttcgccagaatatgccgacggatttcagtcagtaccgcgggctgattggtgccgatataaaaaacctgctgatttttttccgctgcaaaggtatcaaggcgaacggcaaaaaccgccagttttccggcgcagccggaagattcaaacaaacggtccgggtcggcgttatagcgggcgggcgtatcggcgttgatatctcgtacccgcgtcacgtagtcgtgatcgtgcgcatgacgaccatcgtgacgcacatcctcatctttaatccgttcatcatccagcttgctcaggatctgctccggcgtatgcccaagatcgatacccagatgattgaccagttgcagtttgccttgctcgtcaatacgggcaaagagcgacatctcggtataggccgggccgcgctgcaccagcgagccgccggagttattacagatgccgccgatgaccgacgcgccgatacacgacgaaccaatcaccgagtgcggttcacggcccagcggtttaagcgctttttccagcgcatagagcgtcgtaccgggccaggccagaacctgttggccgttatccagtaagtgcagcttatccagccgctgggtgctgataatcacaatatcgcgatcgtagtcgttgccgttcggcgtggagccttccgtcagaccggtgttggcggcctgcatcagaataattttgtcagcgttaacgcaggcgttgagcacacgccacagttccagtaatgaacccgggaaaacaacggccagcgcgtcgccctgaccggaacggaaacccttgcgatagcgggcggttttggcggggtctgtcagcaggtgagaatggcctaccaggcgggccagctcattcaggaacgttttattatcagtcattgttatggaagacattctccactccttgtggtgggacaaaatatcagcgttaagcatagcgctttgtatgacaatacgctttctcattcaaattgtttctgtgttggtggtattcatttgccgccttgataccatttgctggcggttgcgtattcgactgtgcggaaaattaggagaataaccttcgctttcttctcctctcgcgtttaggcttatggcaaactgcggtttttattctgtttttaccgcctcgtcgggataaagataaagagagactcaacatgaaatggttatgttcagtaggtgttgctgtgagtctggcgatgcagccagcattggcggaaaacctgtttggcaatcacccgctgacgcccgaagcgcgcgacgcgttcgtcacggatttactcaagaaaatgactgtcgatgaaaaaattggtcagttacgtctgattagcgtcggccctgataacccgaaagaagcgattcgcgagatgatcaaagacgggcaggtaggggcgattttcaataccgtcacccgccaggatatccgtcaaatgcaggatcaggtgatggcattgagccgcctgaaaattcctctcttttttgcttatgacgtggtacacggccagcgaaccgtcttcccgataagcctcggtctggcttcttcttttaatctggatgcggtaagaaccgtaggacgcgtatcggcgtatgaagcggcggacgacggtctgaatatgacttgggcgccgatggtggatgtctcccgcgatccgcgttggggacgcgcctccgaaggctttggcgaagatacatatttaacctccatcatgggcgaaaccatggtgaaagcgatgcagggcaaaagcccggcggaccgctattcggtgatgaccagcgtgaaacattttgccgcctatggcgccgttgaaggcggtaaagaatacaacaccgtggatatgagttcccagcgtctgtttaatgactacatgccgccgtacaaagcggggctggatgcggggagcggcgcggtgatggtggcgctgaactcgctgaacggcacgcctgcgacgtcagattcctggctattgaaagatgtcctgcgcgatgagtggggctttaagggaattaccgtttccgaccacggcgctattaaagaactgattaaacacggtaccgcggccgacccggaagatgcggtgcgcgtggcgctaaaggcaggggtggatatgagcatggcggatgagtattacagcaaatatctgccgggtctgattaagtcgggcaaagtgacgatggcggaactggacgacgcgacgcgccatgtgctcaacgtaaaatatgacatgggattgtttaacgacccctatagccatctgggaccgaaagagagcgacccggtggacaccaatgccgaaagccgcctgcatcgtaaagaggcacgggaagtggcgcgggaaagtgtggttctgctgaaaaaccggctggaaacgctgccgctgaaaaaatcgggcaccattgccgttgttgggccgctggccgacagtcaacgtgatgtaatgggaagctggtctgctgctggggtcgcgaatcagtcagtgacggtgctggcgggtattcaaaatgccgtcggtgacggggcgaagatcctctatgccaaaggggcgaatatcactaacgataaagatatcgtcgatttcttaaacctgtatgaagaggcggtgaaaatcgatccgcgctcaccgcaggcgatgattgatgaggcggtgcaggcggcgaaacaggccgatgtagtggtcgcagtggtaggcgagtcgcaggggatggcgcatgaagcctccagtcgtaccaatatcaccattccgcagagtcagcgcgacttaatcaccgctctgaaagccaccggtaagccgctggtactggtattaatgaacggcagaccgctggcgctggtaaaagaagatcaacaagccgatgcgattctggagacctggtttgccgggacggaaggcggcaacgccattgccgatgtgctgtttggcgattacaacccgtcaggcaaactgccgatctccttcccgcgttcggtgggacaaattccggtctattatagccatctcaatacgggacgcccgtataatcctgaaaagccaaacaaatacacctcacgctattttgacgaagcgaatggcccgctctatccgtttggttacggtctgagctacaccacatttacggtgtctgacgtcacgctctcctcaccgacaatgcaacgcgacggcaaagtcacggccagcgtagaggtcacgaataccggtaaacgcgaaggggaaacggtcatccagatgtacttacaggatgtcacggcgtcgatgagccgcccggtgaagcaattaaaaggctttgaaaaaatcaccctcaagcccggcgaacgtaaaaccgtgagtttcccgattgatatcgaggcgttgaagttctggaatcagcagatgaaatatgacgcggaacccggcaagttcaacgtctttatcggcgtggattccgctcgcgttaaacaaggatcgttcgagctactgtaagcctgccgtcaacagggcgcgatagcagcgccctgtctggcaatgactttttctgtcccccccttttattgcctgccacgtcacttaaactgccggaaaatcccaggttaaacgcagacttttcaactatgcttttttctcaagtttctgaaaaaggccgtaaaaggatgaggaaagcatcatgacgatctcaaagctatgggtaagttcgctggcgttgctggcgacggtgagtttacctctacaggcggcatcgcccgtgacggtcgggtcaaagattgataccgaaggcgcactgctcggcaacatgattttgcaggtactggaaagccacggcgttaaaacggtcaataaaattcagctcgggacgacgccagtcgttcgtggcgcgattaccgccggagagctggatatctatccggaatacaccggtaacggggcgttcttttttaaagatgaaaacgatccggcatggaaaaatgcaaagcaaggctttgagaaagtcaaaaaactggatgcggagcagaataagctggtctggttgacgcctgcgccggccaacaacacctggaccatcgcgatacgtcaggacatcgcggaaaaaaataaactctcctcgcttgccgatctcagccgttatctgaaagagggcggcacttttaaactggcggcgtctgcggaatttatcgaacggtcggatgcgctgccggcatttgaaaaagcctatgattttaccttgaatcagaaccagctcttgtcgctggcgggcggcgatacggcggtcacgatcaaagccgccgcgcaacaaacatccggtgttaacgccgcgatggcgtatggcaccgacggcccggtcgccgcgctgggtctgcaaaccctgagcgacccgaaaggcgtccagcctatctatgcccccgcgccggtagtgcgtgaatcggtgttacaggcctatccgcagatagccgattggctgcagcccgttttcgccagccttgatgagaaaacgctgcaacagttgaacgccagaatcgccgtagaagggctggatgcgaaaaaagtcgccgcagattacctccgacaaaaagggtgggtgaagtaatctgtgagtgacgctgccaaaaaaattacggttaatcgtgtgctgttgctgttggttgttctggccctgcttgctgtcgcgctgcctttcattaattacgccccgaatcgtctggtgagcggcgaggggcgccagttatgggagatctggccggcgaccatctggatgctgactggcgcgggatgcgcgctgtttacgctgtgctttgtgcccggtaaacgcggtagcgtactgacgctgatgatggcgcagacgctttttattgtcatgctgtggggagtcggcagggcggcgacccagttggcgcaggagggcagtccgctggcgcgtaccagtctgggaagtggattgtggctgggcctcggtctgatgctgctggcctgtagcgatgcgatccgccgtattaccgttgggccgctgtggcgctggttgctgcacgcgcaaattgtcattgtcccgctggcgctgctgttttcaggcacgttcgacaacctctcgcttctgaaagagtataccaaccgccaggatgttttcgatgccgcgctggtgcaacatttaatgttactggcgggcacggtgctgccggcgctggcgatcggactaccgttgggcgtctggtgttatttttccgcctcacgccaggggccggtgtttaccgtactgaatgtgatccagactattccttccgtcgcgctgtttggcctgctgatcgcgccgttggccgggctggtgaaacagtttccgtggcttgccgaattcggcgtcgcgggaaccggcatgacgcctgcgctgatagcgctggtgctctatgcgttattgccgctggtgcgcggcgtggtcgccgggctcaatcaggtgccacgcgatgtgctggagagcgcaagagcaatgggaatgagtagcggccagcgcttcaggcatgtgcaactgccgctggcgctgccggtctttttacgtagcctgcgggtagtaatggtccagacagtgggaatggccgtcgccgccgcgctgattggcgcgggaggtttcggcgcgctggtgtttcaggggctattgagcagcgccattgatttagtcctgttgggcgtcattccggtgattgcgctggcggtagtgatcgacgcgctgtttgatttatggatcgcgtttttgaagggagcaaccgatgattgaatttaaccatgtcagtaaaaccttcggcgatcaacaggctgttagcgacctcaatttgcactttagcgaaggcagcttttcggtgttaattggcacctccggttcgggaaaatcgaccactctgaagatgattaaccggctggtagagcatgatagcggaacgatccgttttgccggtgaagagatccgcagcctgccggtgcttgaactgcgccgtcgcatgggctatgccattcagtctatcggcctttttccccactggacggtggcgcaaaatatcgccaccgtaccgcaactacaaaagtggtcgcgtgcgcggattaacgatcgtattgatgaactgatggcattattgggtctggaaagcgcgctgcgcgatcgctatccgcatcagctttccggcgggcaacagcagcgggtcggcgttgcgcgggcgctggctgccgatccgcaggtattgctgatggacgagcctttcggcgcgcttgatccggtaacgcgcggcgcattgcagcaggagatgacccgcattcatcagctactggggcgcaccatcgtactggtgacgcacgacatcgacgaggcgctacgcctcgccgaccatctggtgctgatggacgggggccacgttatccaacagggatcgccactttctatgctgacctcgccggaaaatgatttcgtgcaggcattttttggccgcagcgagctgggcgtaaggctgctttcgttacgtagcgtaggcgattatgtacgtcggcatgaacagctcagcggcgacgcgctggtggaagagatgacgctacgcgatgcgctatcgatgtttgtcgcccgtcggtgcgacgtcctgccggtggcgaatcagcagggcgagccctgcggtacgctccatttccgcgatctgctttcggagacgtccccccgtgaaacgactgtgtgatccgcttctctggcttattgttctgttcttgcttctgctgtttggattgccttatagccagccgttcttcgccgcgctgtttcccgatttaccgcgcccggtctaccaacaggagagttttgccgccctcgcgctcgcccatttctggttggtgggcatctcaagtttgtttgccgtcgtggtgggcgtcggcgcagggattgcggtcacgcgagaaagtgggaaagagtttcgtcccctagtggagactatcgccgccgtcgggcagacctttccgccggtcgcggtactggcgatcgcggtacccgtcatgggttttggtcagcaaccggccattatcgccttgatcctgtatggggtgttgcccatcctgcaggcgaccctggccgggctgggcgcggtgcctgccagcgtgatgagcgttgccagcggtatgggaatgagccgtcgccaacagttgtatcaggttgagctgccgctggccgcgccggtgattctggcgggcatccgaacctcggtgattatcaatattggtacggcgaccatcgcttcaacggtgggggccagtacgttaggcacgccgatcattatcgggcttagcggctttaatacggcctatgttatccagggggcgctgctggtggcgctggcggcgatcattatcgatcgcctgtttgaaaggctgacgcgcgcgcttacccggcacgcaaaataaaactgtaacctgccagcatcacgccgccgataccgccaatagccatcagcaggaaaagggcgatcaccccgattttcgctacgcgcattatgtactccttatgttaataaaaggagtatacattaaagcgaatttgttagctgctgtttaaacgccaaggggatgaatgtcgtgtccctgggcgcgccatgccaggagttgctgctgctgcgccagcgtctggtgttctccgcaccataccagtaacgtcttgccgtcaaaaagttccgggcggaactggctaagcgaatgcgccaacacgtcgattcgccatccctgttggctggcgacccaaccttccagccacaggcgggtggtatcatggatattccagccgatcaccaacgcatcttttccctgtttcttacgcgcagacgccaggcagagcgcaatatagttgatcaggataccgtcaagaatgccgagcagcgcctgaagggcgggttgttggcactgtaatcgtcgccgcagtgggacgaacaggttagtggtcaatgtttgggcaggataatcctgaccgcgttctttgacccataaccgtaaactgtgcagattactgctttgcaggtagtgcagcaggatctcctgctgttcgcgccagccgttaggttgttcgctactgtcgctactgagcagcactttgactttgctgacctggacgccgttatctatccagcgcttgatttcgcggattctgtcgatatcggcatcgttaaacagacgatgaccgccatccgttcgctgtggttttaaaagtccataacgtctctgccacgcgcgcaacgtgacaggattgatatcacaaagcaaagccacttcaccaattgtgtaaagcgccatcgtttcacccttgctcgcgaggtcccggtttaactttagacgctcttttaggaaccaggaagttttgcctgttttttatgcattaaaacgcgaagtagcgggttgcggcgcggcgtttaagtgatcgtattcacgaattcatatttttatgcaacagttcaaagaaagttaatcgtactcaatgtatgttacgcgcttttaattgaagtgtggtttgcgggtatgtacgagtttaatctggtgttgctgctgcttcagcagatgtgcgtgtttctggtcattgcgtggctaatgagtaaaacgcgcctgttcatcccgcttatgcaggtcacggttcgtctgccgcacaagcttctgtgttatgtcacgttttctatcttctgcattatgggcacttattttgggctacatatcgaagattcgattgccaatacccgcgcgattggcgcggtgatgggcggcctactcggcgggccggtcgtcggcgggctggtcggtctgaccggtgggttacatcggtattctatgggcggcatgacggcgctgagctgtatgatttccaccatcgtcgaagggctgctgggcgggttggtacacagcgttctcatacgtcgcggacgcccggacaaagtgtttagcccgctgacggcgggagcaattacgtgtgttgccgaactggtgcagatgctgatcattttactgatagccaggccgtttgacgatgccctgcatctggtcagtaatattgccgcgccgatgatggtgacgaataccgttggcgccgcgctgtttatgcgtattttgctcgataagcgcgccatgttcgaaaaatatacttcggcattttctgttaccgcgctgaaggtcgccgcgtcaacggaggggattctgcgtcagggatttaacgaagtgaacagtatgaagatgacgcaggtgttatatcaggagctggatattggcgccgtcgccatcaccgatcgcgaaaaactgctggcttttactggtattggcgacgatcaccatctaccgggcaaacccatttcatcaggttatacgctgaaagcaattgaaaccggagaggtggtttatgccgatggcaacgaagtgccgtatcgctgttcgctacacccgcagtgtaaactcggctcgacgctggtgatcccgctgcgtggcgaaaatcagcgagtcatgggcaccattaaattgtacgaagcgaaaaaccgactgttcagctcaattaaccgtactctgggggagggtattgcgcagcttttatccgcgcagatcctggccgggcagtatgaacggcagaaggcgttgctgacgcagtcagagatcaagctgttgcacgcgcaggtgaatccgcattttctgtttaatgcgctcaataccattaaagcggtgattcgccgcgacagcgaacaggccagccaactggtgcagtacttgtcgaccttttttcgcaaaaatttaaaacgcccgtcggaaatcgtcacgctggcggatgaaattgaacacgtgaacgcttacctgcaaattgaaaaagcgcgttttcagtcgcgtctgcaggtacagcttgatgttccatcgacgctttcacgtcagaaattgcctgcgtttacattacagccgattgttgagaacgccattaaacatggcacgtcgcaactgcttgataccggcaacgtcgctattcgcgcccggcgcgaagggcagcatttgatgttagatattgaagataatgcgggactgtatcagccttccgccggcagtagcgggctggggatgagtctggtggataaacgtctgcgcgaacactttggcgatgattatggtattagcgtggcctgcgagccggactgttttacccgaattacattacgacttccactggaggaggacgcatgattaaagtgctgattgtggatgatgagccgttagcgcgggaaaatctgcggattttgctccaggggcaggatgacattgagattgtgggagagtgcgcgaacgcggtagaagcgattggcgcggtacataagttgcgacctgatgtgctgtttctggatattcagatgccgcgtatcagtggactggagatagtaggaatgcttgatccggaacaccgcccgtatatcgtttttttaaccgcgtttgacgaatacgccatcaaagcctttgaagaacacgcttttgattatctgctcaagccgatagaggagaaacggctggaaaaaacgttacatcgtctgcgtcaggagcgcagtaaacaggatgtttcgttgttgccggaaaactcgcaggcgcttaaattcattccctgtaccggacacagccggatctatttgttgcaaatggatgatgtcgcctttgtcagtagccgtatgagcggcgtttatgtgaccagcagtgaagggaaagaggggtttaccgagctgacgctgcgcacgctggaaagccggacgccgctactgcgttgtcatcgtcagtttctggtgaatatggcccatttgcaggaaattcggctggaggataatgggcaggcagagctgattttacgcaacggcctgacggtgccggtaagccgtcgctatctgaaaagtttaaaagaggcgattggcctgtaaaagactgttagaatatcgttttgccatagaaacgaccgaaggcctcatgctgagtaacgatattctgcgtagcgtgcgctacattttaaaagctaataataccgatctggtgcgtatcctggcgctgggtaacgttgatgctacgccggagcagatagcaatctggttgcgcaaagaagaggaagaggggtttcagcgttgcccggatatcgtgttgtcctcatttctcaatggcctcatttatgaaaaacgcggcaaagatgaggcggcgcctgcattgacggcggaacgtcgtatcaacaacaatattgtgctgaaaaagctgcgtattgccttttcgctaaaaacagatgatatcctggcgatacttaccggtcagttgtttcgtgtctcaatgccagagatcaccgcgatgatgcgcgcgccggaccataagaacttccgcgaatgcggcgatcagtttatgcgttattttctgcgcggtctggcggcccgtgaacacgcggcgaagtaattctgcggtattgttcccggcagcgtcctgtctgaccgggaaaacgcattattatactaattgattctatgatacccgctctcttccaacagtttctgcgagcgaatcattgacagatagtacgcggaacagttgtcaattgatgatcctggcaatttacagaggtcgcttatttttgcctgggtaaaatcaatatccacatattccgtagcatagctatcataatagtcgattcgttcagtcaaacccggcataccctgataagcttcgccgacttgactcagcattttttgtgcttcttctttattattggctttcagggtcttataaagtagtttatgttcagatatttgacgtaaaacgatatcccctttgtagtaataggttaacttgatttcaataccgttgagattacctacatagcgttgtgtttcctctgactctttgctagcggctatcttcttgataaacgctgtcatgttattttgctttccctggagagtatcgtttttctgatcgcagccagttatgctaaccgatagagagagcgcgaatagtggcagtgccataagacgtagaacctgcataacaattccttgtcgttaagtattggtgtggccaggaattcagggattataggctttggcgaggggacttacagcgaggctgtcttttttcggaattcataaagaaaagacgctgccgaagcagcgccctgagcgactttaccagtcgatgcaatacattatgcctgccagttatttcgcttctttaaaaccagcagcttccagcagcgtctgggtttgtttcatgctgatacctttgctggtatcgccggacaccatcgtccctgagatttgctgtaacgctttaaagtccactttttccatatccacagagacgttttcctgggcataggtatcttcataggttaatttttcttccactccggcgatatttttatatttcgcgctcagcggatcgagaattttggcggcatcttctttcgttttagcgcctacagtggcatagctgattttactttcagacgtctgcttaatgattttgtcacctttataggtgtaagtaattgaaatttctgtccccgccaggtttgcgttaaaggtctttgattcttctttatcgccacagccagcaagagagaacaccagtacggaagccaaagccgcggacaataacttgccagaaattttcatctaaaactccattttatataatgattgggtttttaaaataatttcaatgaattaatttaacccagtaatagcaatgtatcagggagagatagaatatgacttttagccgttatttagcagtccggatatggagtcttaacgctattgcttattaaggaaaaagttaaaacacgcggatggggtgatatgccagtcaggattaagcggttaaaaaagccggagcatgctccggcttgttgcttatttcacctgttggccaggcttcgcgccgtcattagggcttaacaggaagatatctttcccgccaggtcctgcggccatcaccattccctcggagacgccaaagcgcattttgcgcggcgcgaggttggcgaccattaccgtctggcggccgatcagcgcctgcgggtccgggtaggcggaacgaatgccggagaagacgttacgcttctcgccgcccagatccagcgtcagacgcagcaatttgtcagaaccatctacgaactcagcgttttcaatcaatgctacgcgcaggtcaattttggcgaaatcgtcaaaggtgatggtttcctgaatcgggaagtcggctaacgggccggtaaccggcgcggctgcggctttcacctcttctttagacgcttcaaccagcgcttcaacttgcttcatgtcgatgcgattgtagagcgccttaaaggtgttgaccttgtgactgagcagcggctgttcgatggcatcccagttcagttcgctgttcaggaaggcttcaacgcgttcagaaagcgtcggcagtaccggtttcagatacgtcatcagcacgcggaacaggttgatgcccatcgagcaaatggcctgcaggtcagcgtcgcggccttcctgtttagccaccacccacggcgcttgctcgtcaacataacggttagcgacgtcggccagcgccataatctcacggatagctttaccgaattcacggctttcccatgcttcgccaatcaccgcagcggcgtcagtaaaggttttgtacaattgcggatcggccagttcagccgccagcacgccgtcgaaacgcttattgataaaaccggcgttacgggatgccaggttgactactttattgacgatatcggcattgacgcgctggacaaagtcttccaggttcaggtcgatgtcatcaatgcgtgaagaaagcttcgcggtgtagtagtagcgcaggctgtcggcgtcaaagtgtttcagccaggtgctggccttaataaaggtgccgcgagacttagacatcttcgcgccgttcaccgtcacgtaaccgtgaacgaacaggttggtcggcttacggaagtggctgccttccagcatggcaggccagaacaggctgtggaaatagacgatgtctttgccgataaagtgatacagctcggcgtcggagtcttttttccagtactcatcaaaactggtcgtgtcaccgcgcttatcgcacagatttttgaaggagcccatatagccaatcggcgcgtccagccagacgtagaaatatttgcccggcgcgttcgggatttcgaaaccaaaatacggcgcgtcgcgggaaatgtcccactgctggaggccggattcaaaccactcctgcattttgttcgccacctgctcctgcagcgcgccgctgcgggtccacgcctgcaacatttcgctgaatgacggcaggtcaaagaaaaagtgctcggagtcacgcattaccggcgtcgcgccggacaccacggatttcggctcgataagttcggtcgggctgtaagttgcgccgcagacttcacagttatcgccgtactggtccgcggatttacatttcgggcaggtgcctttcacaaatcgatccggcaggaacatgcctttttccggatcgtagagttgagagatggtgcggttcttaataaaaccgttctctttcaggcgcgtataaatcagctcggacagctcgcgattctcgtcgctgtgcgttgagtggtagttgtcgtagctaatattaaaaccggcgaaatcggtctggtgctcctggctcatttcaccgatcatttgctccggtgtaataccaagctgctgcgctttcagcatgatcggcgtgccatgagcgtcatcggcacagatgaagttaacctcatggccgcgcattcgctggtaacggacccagacatcagcctggatgtgctccagcatatggccgaggtggatagagccgttggcgtacggcagcgcgcacgttaccagaattttcttcgcgacttgagtcatagtgggtattacttcttctgttgtaaaaaagggctttgatagtaccaaaatggtaattactgcgccaatcgataagggcatttatccgtaaatgaataattgttaccgctggagtaaactacaaagttacaatcgtacttttcagaactacaaaaggagtcgggatgaacgaacaatcccaggccaaatcaccagataccctgcgagcgatggtcgccgggacgctggcgaattttcagcacccaaccctgaagcataacctcaccacgcttaaggcgttgcaccacgtcgcctggatggatgatacgctgcacgttgagctggtcatgccgttcgtctggaacagcgcgtttgaggtattaaaagagcaatgcagcgccgatctgttacgtattacgggcgcaaaagcgatcgactggaaactgtcgtacaacattgcgacgctgaaacgcgtcaaaaatcagcctggcattaatggcgtgaaaaacatcattgccgtgagctccggtaaaggcggggtgggtaaatcgtccacggcggtaaacctggcgctggcgttagaggctgaaggcgcaaaggtcggggttctcgatgccgatatttacggtccgtcgatcccaaccatgcttggcgcagaagatcagcgcccgacatcgccagacggtacgcatatggcgccgattatgtctcacggcctggcgaccaactcgatcggctatctggtgactgacgataacgcgatggtatggcgcggcccaatggccagtaaggcgctgatgcagatgttgcaggagacgctgtggccggatctggattatctggtactggatatgccgccgggaaccggggatattcagctaacgctggcgcagaacattcctgttaccggcgcggtggtggtgactacgccgcaggatatcgcgctaatcgacgccaaaaaaggtatcgtgatgttcgagaaggtggaagtgccggtgctcggcattgtggaaaatatgagtatgcatatttgtagcaactgcggccatcacgaaccgatcttcggcacgggcggcgcgcagaagctggcggaaaaataccatactcagcttctgggtcagatgccgctgcatattagtctgcgtgaagatctcgatcgcggtacgccgacggtggttagccgtccggagagcgagtttaccgcgatctatcgcgaactggccgatcgcgttgcggcacagctttactggcagggtgaagtgattccgggagaaatcgccttccgcgcggtgtaatcctcctgacgtattccaaagagaatatgacattcactgcattaatatatattgatgcagtgaatgtattaataaaataatagcccccgcattgttaattcctgcttaaacagacaggtgtttatctgaaataatcggcaaaaacattatttgaattgatcatacctatcctactgatttattttttcaattggttttaaggtatcgatacgttcatactgctcatcaggacggcctgcatactgtttgacgttcaccagaggaacaattactcactatgaaaaaatatttgctgatgggaattatagtttcggcttatgggataagcgtacctgtttttgcctccgacaccgcaacattaaccatcagtggaaaagtgaccgcgccaacgtgcagtacagaagtggtaaacgcacagttgcagcagcgttgcggcaacactatccacgtttcaactctgcaaacacccgccgctacgccgatgagaggtgtgacaacgcagctatacacggtgcctggtgatagcacccgacagattgttgttaatcattacgactaattcttattaattccgcaggcccatatcattgatatcaatgatatgggcttttttatttgttgtgtttatgtttaagggcagtaaatttcggaaattaataagtttacaaaataatgataagcaatgattatttgttgcaattatattgcaatctgtaaattgttttaaatcaacaaaacatcgtgtttacattgcgataacttcctgtctatgagaattttcgttgcaagggttaataactcttaacaaatagaaattacttcattaaggaagagattatgaaacgttcacttattgctgcttctgtattgtctgctgtatttatgagcgctggggcttttgctgttgatgagtatgattcaggcgttctgaatattaacggaaaggtggttggtactacctgtcaatttttgggtacgaacaccgctgaaattagactgaatgaaattggtgcggataaaataattaatttaaccccgggtcagatttatgacgcagtaactaatcaaactcagatgccgttgaaaataaaatgtcaacagggtgtagcgccgcgtattaccttctcttcaacgcaatttgacagccacgatatcacatttaataacgggtctgccaaaggtgtcggttttgcggtttactacggaagtacggataatcagattgatccagagacgggggtgacactagatccaaatagcagcggtgaatacgacctgacttttttagcacgctatgcgcgtttagacggtgatgttgcttctggtgatgttagctcaacactgactttaacggttgttactgactaatttattcaaccggcggcgttcgtcgccggttttttataagcaaggccgtgtaaatatgaaaatattatctgcagtattattatctgccataattttgcctgcgcatgctggtattgttatttatggtacgcgtgtgatttacccggcagagaagaaagaagtcgttgtacaattggtgaatcagggcgagcaagcttcgctggtacagtcctggattgatgacggtaacacttcattaccgccagaaaaaattcaggtgccatttatgctgacgccgccagtggcgcgcgttgccgctgagtctggtcagcagatcaaaatcaagaaaatgcctaatagcttaccggacaacaaagaaagtctgttttatctgaatgtgcttgatattccaccaaacagccaagaaaacgccggtaaaaatgtgcttaaattcgcaatgcagaatcgaataaaattaatatggcgccccagtcgaattgccgccgtaaccaaagacagttttcagaggattggtttatttcgcagtaataaaactgtcatcatgaaaaatgatactgcaaactggattaccgtgacggatgtaaaagcaggaaatactaagattaatgatcaaactatcatgctgccaccgctatcgacgcaaaatattaacatgaaatatgcgtcaacaagccagtatgaagtaacgattattgatgataatggtaactatattagtagcaaaattaatgtaaaataaacaggagttcatcatgctaaggatgacgcccatcgcttcgcttgttttattgactctgtttacctggcaaacgcaggctatcgcgacggaaacgtttgatactcattttatggtgggggaatgagagatcaaaaaataacaaatttccatctggatgagaataagccaattccgggacagtacgaattggatatttatgtcaacaatcaatggcgaggtaaatacgatatcattgttgccgatgatcccggtagcacgtgtatttcaactgagttgttgaaaaatattggtgtgataagcgatggtctgcaaccgcagggagcaacggattgtattgcgttaaaagatgtcgtgagaagcggtggctatacttttaatattggcgtttttcggctggatttgagcgttccccaggcctatgtaaatgaggtcgaggcgggttatgtattgcctgaaaactgggatcgcggcatcaatgcattttatacttcttactatgccagccagtattacagtgactataagaattctggcagtagtgaaagtacttacgttcggttcaatagcggtttcaatctgttgggctggcaagcgcatgcggataccacatttaataaaaccgatggcagcagcggtgagtggaaaagcaacacattgtatctggagcgcggtatcgctgagctcctcggcacattacgcgccggggatcagtatacctcgtcagagatttttgattctgtgagatttaccggcgttcgcctgttccgcgatatgcaaatgttgccaaactcgaaacagaattttacgccgttggtgcaggggattgcacagactaacgctttggtaaccatcgaacagaacggattcgttgtttatcagaaagaggttcctcctggccccttttccattgcggatctgcaactcgcgggcggtggcgcggatcttgatgtcaccgtgcgtgaggcggatggttcgataaatacctggctggtgccttacgcttccgtaccgaacatgttgcagcctggcgtctctaagtatgatttttccgccggccgtagtcatattgaaggcgccgataatcaggccgattttacacaaatcagttatcagtatggccttaataacctgttgacgctttatggcggtacgatgctatcgaaccattataatgcgtttaccctcggcacggggtggaatacccggattggcgccatttcgcttgacgctacgcgagcgcacagtaaacaggataatggcgatgtatttgatggtcagagttatcagattgcttataataaatacctgacccaaacattaactcggtttggtctggctgcgtatcggtattcatcacaggattaccgcacatttaacgatcatgtctgggccaataataaaaataactatcgtcgcgataagaatgatgtatacgatattgctgattattatcaaaacgattttgggcgtaaaaatacgttttcagctaatgtgagccaatccttgccagaaggatggggcgcagtatcactgagtgcattatggcgtgattactggggacgtagcggcaccagtaaagattatcaaataagctattccaatacgttccagaaaattaattatacgttatccgccagtcagacttacgacgaggatcataatgaagataaacgttttaacctgtttatttcaattccctttgactggggggacggtattactaccccgcggcgtcatctgaatgtgtcgaactcgacgacctttgatgatgatggatttacctcaaacaatattggtttaaccggtacggcaggcagtcgcgatcaatttaattacggcgtgaatgttagtcatcagcgacacgatagtgagaccacagcggggacgaatttaacctggaatacgcccgttgcaacgcttaatggtagttacagccagtcgtccaattatactcagaccggcggaagtatttccggtggggttgtagcctggagtggcgggttgaatttatccagccggctttcagatacctttgcgattatgcaggctccgggacttgaaggagcctacgttaacggccaaaaatatcggaccaccaataaaaaaggaacggtggtttatgacaaccttacgccatatcgcgaaaaccatcttatgcttgatgtgtcgcaaagtagcagtgaaacggaattacgcggtaaccgtaaagttgccgccccgtaccgaggggccgtcgtgctagtgaattttgataccgaccagcgtaaaccatggtttattaaagcgcagcgtcctgatggctcgcctcttatttttggttatgatgtagtagatcatcatggtcataatgtgggcattgttggacaaggtagtcagctatttattcgaacgaatgatattccgcccgaagtcagtgtaccagtagataaagagcaggggctttcatgttcaatcacctttggaaaaacggttgatgaaagtaaagtttatatttgtcggtagtggtgaggtggtgaaatgaaactctttctttttatcgtgatgttattgattttacctgaaacatacgcagcctgtacgggagaaattacttatcaggataatttaattattcgtgaggattttacgattaaccctaatcagtccgcaacttatagccataattttaacgatacaacttgttcagggacttataagataacgcgtatggatccttccgatatcatcgtgggattatacaatgatacagtaaaactgaagttaaaaatcgcctgggcagataataatactctcacaatgccgtttacaacgggctatacggtaacggttgaacccgcttcctctggggcgaatgtaaatatttctgccggtagtgggaacagtgtcctaatcaacggggtggtatcaataacaagcgcttcttctgcaactcagtttacggccagtttgcggtttttagggtgcctgctagcaggaagaggctggaatgcctgtgccgcagattataatagttatcttagaggtgcagggttatattcatttgatctgtttgtgtcctacgatcgcaagcagacaacctgcaaacctgaagatctgacgatcacgctaccgaatattgcgctttctgaattatataacacaggcaaggtcagcaacaaaaatgccgcggataatattcgactccagtgtgataatctttttggtaatgctaaacaaacatcgcgtaaaatgacggtttatctctccagcagtgatttaataccagatagctattctgtgttgcgtggtgctgtgaataatggcgtcggatttatactggagagcggtggaaaaacggtgaatatttcaaatacagcagagcagggtaatgcttcaacgttatggaaagtggatcaagtaggcacgccgctcaacagtgatatgataacaatccctattatcgccagttattatgtttatgaccgagacaatataaagccaggcgatctaaaagcgactgcgctgatctatgtgaaatacgattaatatatatgaaaaacatttaagatatatggcgcgataggtgaatgaacttccggtcacttacaataataagtgaccgggatgacaatctttctgcaataaattctaatgtggtatgcggtagtttcaaaagggcgagatccagagcgaatcgggtagtgaaggcagtcaacaaaaaggaggtttgaaggggatagagtgattaagggctaataaaaaagtaacatggggctgtatttccccctctggatgagggggctttttttatcgatgataaaaaatctcgccatcataggctttgatgatttttccatcggtatcgttaatcagtacatacgcgccgcccatataggtccagtgagtaccggcatctggcgcgggcagattacgtaatttccactgtttaatattatactcatcggtgcggtacatttgcggaacggtatcgccgggcttgaagtgggtgaagtcggcgataaagctttttaactcatattgatcaatgcccgttgtcgcgggggcggcccatgcaaaactggttgcaagcaacagcgcgcaaggcagcaacttacttttcatacttttaccctccacatatgcgggtcagttaacatcgtgtgtatcatttctgctggtggcgtatctgacaagcgctattttgttatctcacgccccttttcgtaaaaagtgtaaacgaaagcgtcgtgcagcaacatatccgccagcaagtttgccagaaccgaataggttttgagaactatctgataacgctaaaattatcgtccgccgctgactgtaaatttacattgtctggcacagacagtatgcttaatagcgaaaccccgcttaacacggtggggcttgacgactcggggtgcccttctttgtgaaggctgagaaatacccgtaccacctgatctggataatgccagcgtagggaagtctgacactgctcgtgtcccttcttcacgcgggcaggagctgaaccatgcagcctgacctgcactgccgcacgcttgcggcgcatacgttaaaacactttcgcgcgctctccccgcttacgcactgtatgacgaatgacgtcgtacaaacgtttaccgccaatacgttgctggcgctgggcgcttcacccgccatggtgattgatcctgtcgaggccagaccgtttgccgccatcgccaacgccttgctgattaatgtcggaacattaactgcctcacgcgctgacgcgatgcgtgcggcggtagaaagcgcttatgatgccaaaacgccgtggacgcttgatcctgtcgcggtgggcgcgctggaatttcgtcggcgattttgcctggatctcttgtccctgcgcccggcggcaatacgcggcaacgcctcggaaatcctggcgttatccggcatggcgctgggcggacgcggcgtagataccaccgaggcggcgttggccgcactgcctgcggcgcaggcgctggcgcgtcagatagactgcatcgttgtggttaccggagagatagattacgtcactaatggtcagcgcacgctgagcattcccggcggcgatccgttaatgactcgcattgtaggcaccggctgcgcgttgtcggcggttgtcgccgccagttgcgcgttaccgggcgccgcgctggacaatgtcgcgtcggcctgctgctggatgaaactggctggacaggtcgcggcagagcgtagcgaaggaccgggcagcttcatcccggcttttcttgatgcgctctatcatctggatatggaggcggccaatgcaacgaattaacgcgctgacgattgccggcaccgatcccagcggcggggccggtatccaggcggatctcaagaccttttccgcgctgggcgcatatggctgttcggtcatcaccgcgctggtggcgcaaaatacctgtggcgtacagtcggtgtaccggatagagccggactttgtcgccgctcaacttgattccgtgttcagcgatgtgcgcattgataccacaaaaatcgggatgctggcggaaaccgatattgtcgaggccgtggcggagcgactacagcgtcatcatgtacgtaatgtggtgctggatacggtgatgctggcgaaaagcggcgatccgctgctctcgccctctgcgatagaaacattacgcgtccggctgttgccacaggtatcgctgattacgcctaatttgccggaagccgcagcgttgctggatgcgccccatgcacgtacggaacaggagatgctggcgcaggggcgggcgttactggcgatggggtgtgaagcggtattgatgaaaggcgggcatttagaggatgcgcaaagcccggactggctctttacccgtgagggcgagcaacgttttagcgcgccgcgtgtgaacaccaaaaatacgcatgggacgggctgtacgctgtcggcggcgctggcggcgttacggccccggcatcgctgttggggagagacggtaaacgaggcgaaggcatggctttcggcggcgctggcgcaggcggacacgctggaagtggggaagggcattggtccggtacatcatttccacgcgtggtggtagtatactgcctacagacccgtcgtcaggaaagataaatggaacaagcgcatacccggctcatcgcgcaactgaatgaacgaatttcagcggcggataatacgccgctatacatgaaattcgcccagacggtaaaggatgccgtgcgcagcggtattcttgagcacggtaatattttgcctggcgaacgcgatctcagccagcttaccggcgtctcgcgcatcacggtacgaaaagcgatgcaggcgctggaagaagagggggtcgtcacgcgcgcccgcggctacggtacgcaaatcaataatatctttgaatattccctgaaagaggcgcggggattttctcagcaggttgtcttgcgcggcaaaaaaccggatacgctatgggttaacaaacgcgtggtaagttgtccggatgaggtcgcgcagcatctggcgatccccgcaggcagcgacgtctttttactcaaacgcattcgttatgttgatgaggacgcggtatcgattgaagagtcctgggtgcccgcgcatctgattcatgatgtcgacgcgattggcatttcgctgtatgactattttcgtcgccagcacatttaccctcagcgtacccgatcccgcgtcagcgcccggatgccggatgatgagtttcagtcgcatattcaaatggatggtaaagtgccggtgctggtgattaagcaggtggcgctcgatcagcagcagcggcctattgaatacagcatcagttattgtcgtagcgacctatacgtttttgtgtgcgaggagtagcgcctcgcgcgtgggcgcgcagtcgccgccgcgatgcccgaccacccagctcgccaccgcatttcccagcagtacggcatccgcgagcgaccagcctgacgccagtcctgccagcacgccgccagcatggctgtcgcctgcgccgatggtatccaccacggttgccggaaacgctggcacaacgccggaagattgcgcgctaaaataccacgctccgtctttatcgtggcgcaccaccagcggcgcggaaaagcgttttacccatgcttcgccgaaagtgcgggtatcggtcgcaagcccggcgcgttccgcggcgatgatggcttcctggcgattgagggatacgatgggccggcaggccataatgcgcgccattgcatcgtctgtaatatcaccgattcgcgggccaaaatcgataaaaggcgttacatcgtcgacggtttccagccactggatcagtggctcgccacaggacgaggccagttgatagccggacaggtagacaagactgccccgcggtgtcctgagctgcgacagccagtccgcattccactggttttccacgccgctaaaagacataaacgtgcgttcgccatccggttcgactaacgccagacaccagccgttatctccttcaaccgcgtcaatcacgctggataatccctcttttgccagacggcggcgaatcctctccgcccacacgccctggcccagcggcagcgcattgctggcgtcaatccccagtcgtttcaacgccacggcaatattcagcgcacagccgccgacattgacgctctgttgttgcagttcaatatcgcctccgcgacgcggcaacgtccaggcgtcggcaatgatatcgatcactgccgcgccgataacggtgagcggacgccgggtatgcagggtcggtaataatgtcagcaaccgtgcgccgttcatagtgcctcccgccgttgacgatagctcgccagcgcaacggcatagcgcgcaaaatccagctgattaaccttgtccagcgtttgctttaactgggggttaatggcgcttaccccgtgcaacgcgccgcaaatggcggtagccatcgcgccgatagtgtcggtatcgccgccgaggttagcgcacagcacggcacagcggttaggatcggtattcgccagctccaccatggcgatagcgcagggaaccgattcaatggtgctggttcccgcgccgatgatctgatagagctgttcgctggcagattcgacgccgtcggcgtggcggacaatgtttagcgccagttccagacgtgccgatagcgaggcgctaaacgtggtaatacgcgctgtctgcgcctgatgggcgatggcggggagcgagtcggcaatactttgccacgtgtcgccgttaaccgctcgcgagacggcccaggcgacaaccacggcgccagccaccgccagatcggatttatgcgtcgggctggaggctaacgctacttctgctataaaggctgtcaggttagttggcggcaacaggcagcccaacggcgaaacgcgcatggccgcgccgttagtcacgccgttattttccagcgccgcgatgggtttgccgtcgcgaatcgcattcagcgcaatttttgacgtcgggccgagtacatttttattgaacgcatcaaagcgttccgcccaggcgaggatgttacgcccaataatctcgggatcaatgttgccttcgcattcgagtagcgcgtcggccaggcagagcgccattgcggtatcgtccgtaaactccgcgcggttaaaatagcaggcggcattattttcttttgggccgggcagaaagcggtcaatccagccgaaatgcgctttgacgcgcgttctcggccacagctcagagggcattcccatcgcatcccctaacgcttgcccgtaaagagcaccgagaatacgttctgctttcattttacttccccttgtgtcaacgcaatatcgcgatcgtcaatagcagtgatctctttgtccgattcgcgaaagaaaatcataaacagtagcgcgatgacggcaatcatcactgcgccaaacgtccacatgcccgcccagttgaatgtcagaccgttaaccggttgcggataagcaaacatttttttcatcatcacgccgccgagacgatagcccagcaggctgccgaatccctgacagcagagggtgataagcccttgcgcagcggtacgcatatgaaccggcgcttttttatcgacataaatgtaggcggtgacgtagtagaaatcgtaacttacgccgtgcagcaaaataccgaggaacagcagggcgtaagtgaagtacgtctccgcgccgccatagacaaaaaagccgtagcggatcgcggcggtaataagaccaagtaataatacctttttaataccaaagcgcttagtgaaaaagggtagcgccagcataaagaagatttcagagaactggccgagcgtcatccagccggtggcgtttttcattcccacttctgtcagatagccgttagcgaagatgtagtagaaggccagcggcatcgcaaacaggaaggaacagaagaagaaaacgagaaagtttttatcgcgcagcagaaccagcgcatccagccccagcatcactttaatatccatcttgccggtgctttttggcggcgtgtctggcagacagaacgcaaatacgcccagcaacgctgaacttgcggcggttatgagcagtggaatgttggtgggggaaatatcgttatagcctaacatttgcggcaagaatccacaggcgaggccggaggcaatccacccaatggttcccataacgcgaatgcgtggaaaatcgcgttcaacgtccggtacgttagcgaaggcaatgctgtttgtcagcgcgatggtcggcatataggtcaatgaataggccaggagcagcggaaagaatccggcaaaggtggtttgctgtgccgcgaaatacatcagtacggcacccgcaaacatcagtaccgccaggactttttgcgctgagaaaaaacggtcggtaacggagccgaccagaatcggcgacaggatcgccgcaatggcggtacaggcataagaccagcctatttcaccggcggaaaacccgcttttatttagccatagccacagggggacgaaccaggcgccccagataaaccactccacgaacatcatgaacgacagtttaaaggtcgttttcatttttgaatccttcatgacaggtaaggtacgccacgacaataccacttaataataccttttaaataccattgagcattaattttgaccgatctaacactttttcggacgtgaatcgagtcagcagatagcgccgaaaaaatgcgctaaagttggcaaaaatggtcggtcagtaccaggcttattgcgacccgcaatctgcggggcaggactattcaccttccgataccctatcggaacttacgggagcatagctatgactgatattgcgcagttgcttggcaaagacgccgacagccttttacagcatcgttgtatgaccattccttccgatcagctttatctacccggcaaggattacgttgaccgggtgatgattgacaataatcgtccaccagccgttctgcgtaatatgcagacgctctataatactggacgcctggcgggaacaggatacctttcgatactgcccgtcgatcagggagtggagcactccgccggcgcttcttttgcggccaacccgcgctactttgacccaaaaaatattgttgaattggcgattgaggccggctgtaactgcgtggcctctacctacggcgtactggcctcggtttcacggcgctatgcgcaccgtattccgtttttggtcaaactgaatcacaacgaaacattgagctatccgacagagtacgatcagaccctgtacgccagcgttgagcaggcgttcaatatgggcgccgtggcggtaggcgcgacgatctatttcggttcggaacagtcccgtcgccagattgaagagatctccgccgcttttgagcgtgcgcatgagctgggtatggtgaccgtattgtgggcttacctgcgtaattcttcctttaaaaaagacggcgtcgattaccatgtatccgctgacctgacggggcaagccaaccatctggccgctacgattggtgcggatattgtgaaacagaaaatggccgagaataatggcggttataaagcggtcaacttcggctataccgacgatcgcgtgtacagcaaactgaccagcgataacccgattgatttggttcgttaccagttggcgaactgctatatgggacgcgccgggcttatcaactccggcggcgcggacggcggtgacactgatctcggcgacgcggttcgtaccgcggtgatcaacaaacgagccggtggaatgggactaattctgggacgtaaagcctttaagaaatcgatggctgatggcgtgaagttgattaatgccgtacaggatgtctatctggatagcaaagtcaccatcgcctgagttcaacgaagaaaagccggatgtgagcgcatccggccagcgactggtgttattaacgtagcaacgggcagtctggcggcagccgacagcgtaatgcgccaggcagcacctcaatatgaaattcttgcccgctgagtggttcgccatccagattgaacgtgatttcatgcggtgcatgaatatcaaaccacgctgaggcgccgtcaataatattcggattgtcatctgactgcgtgagtgtggaaaacagcgccggcagcagttcttcgccggtaaaaatccgtagctgtaacagtccgtcgttaatcagcgcggtgggacataattgctgcccgccgccggcctgacgaccgttgccgatgccgatcaccagcgcatctccctgccagtgaaagttttcgccacgtatttcgcagcggtcaggggtcagcgtatccattctcatcagaccgtgaataagataggagacgccgcccaacgcggctttaagtttttccggcgtttcggtggtaatgcgggtgccaaaaccgcccgtcgccatattgataaaacaggttttatcattgaccctggccatatcaatttccatcgcgtttccggcaatcgccagtttcagcgctttgtccagcgcttcaggaataccggcgctggtggcaaaatcgttggcggtgccgagcggcaaaaggcccagtgcgggggctacgccgtcgcggatctggatgagcgcggtagacacttcattaatggtaccgtctccgccgccggcaatcaccgtttcaacgcccagtctacgggcttcatcaacgtaacgctgcgcgtcgcctttttcccaggttacccgaacgtgaatctgtatgccttcgtcgcgaagtagcgtaatggcctcacgtagcggctggttatcagcgcttttgccattgaggatcagtaagctggcgggaaagttagctatccgttatgccttaataggttgaacaacaatctccagaaagtgtatagcagaaatgaaaaagcgaggtcagaacaggatgaaaattgaaacgttgcgcacttattgctttaccgtttttcttcctgctgtacgcagcggtaagcgaagcatggtttaaggcaaatggcgacaagagagatgccggtatgcgcattgagtagcgcttgtgagagtgcaaggaaaccacaaggggtagccagacgctttccgatatagcgcctttaataacgaaacggaggattaacaagacgaacatacgtcagttatcagtattaatttcaaacaccacaatatcagataaaaacctgatatttattaccaaacatactttttaatagcataaaatcgaaatgttctttagactgctttggcaggaacaagacgcactattagcagtacactattcttgttatcaaataaaacctatttagatgatgacttagcgcagtgtcttatagtcgtaccgttgcctgaggtatcgcttttctcataaacataaacaggcatgtgcatgaagaggtttatatgaatgtcacttcaggcgtgaatgcgcaaacgccattgctccccccttctgaatggggtgatgacgaaaaaccggtagctgaaatcgttgagtttaacgcttacggcaataaacccagatgtttaatgtgcctgggaaccacggcattgtttacaggtgctttcagtggggtatgctcaggggctgtcgccagtgtcagtagtggtgctgcatatactaccgctctgacgattttaggcgcatcgtttggcatggggggaattggtatgatgggaatatgcgccggactataccttagcgcaaatggcgtcagaacccggccagcctggccataaatgagcaaacacagcaagtcatagggaaaagatgaattccggagatgacacggggtgttaagcgtccagaccagaggcttatgacttatatagaaacgctttagatagagtatggggtgttatgtattcaagagccgatcgcttattaagacagttttcactgaaattaaatgccgattcaattgcctttgacgaaaacagattatgctcatttattatagataaccgttaccgtatcttactaacaagcactaacagtgagtatataatgatatacggtttttgcggaagacctccggataataataatcttgcttttgaatttctcaattctaatttatggtttgcagagaataatggaccacatttgtgttatgataataactcacaatcattattactggctctaaatttctcactcaatgaaagttctgtagagaaacttgaatgtgaaattgaggtggttattagatcaatggagaatctgtatcacattttacaggataaaggaataaatctggataccgattatacgtgacggtgggaagggtgtttggtgatctggtggtaatagaggataatcaaccccagcaaaacttacatggcctgatgaagatggactgagcgtaggtgcgatggtttgagtattactttgacatgaaatcaaacctctaatccgggaaaacattattttaatccttgtaaaagcggcattaaaacgtgccataactttacacgcttaaattatcagtttttaaccttaatttaataacctggaaactttttgtgtaagtactcacaaagcagttattgatttaattcactgattttaaacgtaaacgtcagaatgctaagtcctgagtctgaccagatgcagggaggattgtgacttgctggctggccatgaataggggaggtctctaaacctaagcgcccatttgcgctttggttagtgtggtcaattttcggatgtggcgggaagtaccacttttttattgattatacgcaaaaaataagcctgcgtaagggagattacgcaggccaaggaggtggttcctggtacagctagcatttatgggttatgtttttcagcgcgttgaataatacccgcattgagcgaagcggtatgtgatcaatttctaagaatcttcccgccatgaaaaaataaccgcaattaactacttagcatgggggttacgcgttgattcgcctgagaaattacgcatcaatagtgcgtaatccagcgtaacgtcctgcgggacgggcatccagacggtatagccatcgccaggcgccaccggcatagcgtcgcctttggcgttctccatctgttccagagtgaaattgatatttccctgcggagtcatcagctccagactatcgccaacggagaatttattcttcaccgccacggccgccagttggcctttacgctcgccggtgaactcgccgacaaattgctggcgttcggaaacggagtacccgtactcgtaattctggtaatcgtcgtgcgtatggcgacgcaggaaaccttcggtatagccgcgatgagccagaccttccagcgtttccagcagcgtagggtcgaagggtttacccgcggcggcgtcgtcgatggccttacggtagacctgggcggtacgggcgcagtaataaaaggatttggtgcggccttcgattttcagcgagtggacgcccattttcgtcaggcgctccacgtgggcgatagcgcgcaaatcttttgagttcatgatataggtgccatgctcgtcttcgaacgcggtcatgtattcgcccggtctttgggcctcttctatcataaacactttatccgtcggcgcgccgataccgagcgtcggctcaacgttctgtaccggaatcggttcatgcttatgcacgatgttgccgacaacgtcttcttttccttcctgcacgttatattcccaacggcaggcattggtgcaggtgccctggttcggatcgcgtttattgatgtagccggaaagcaggcagcgaccggaataggccatgcatagcgcgccgtggacgaaaatttctatttccatatccggcacctgctggcgaatttcctcaatctcttccagcgacagctcgcgggagagaatcacgcgggtcagccccatctgctgccagaattttaccgtcgcccagtttacggcgttagcctgtaccgacaggtgaatcggcattgccgggaagtgctcgcgtaccagcataatcaaccctggatcggacatgatcagcgcatccgggcccatctcgacgacgggtttcaggtcacggataaaggttttgagcttggcgttatgcggggcgatgttcaccaccacgtagaatttttttccgagcgcgtgggcttcgttgatgccaagctgcaaattttcgtgattgaattcgttattgcgcacgcgtaaagagtaacgcggttggcccgcatagacggcatcggcaccgtaagcgaaagcgtaacgcatatttttcagcgttcccgctggcgaaaggagttctggtttaaacatcattttctcgttctgatgacaggtcagatccgcctcacctgatgaggcggctggaagagagtcctcactttaagggcgggcattgtacgcttacggacaggccgagtaaatattgcgagagtatattggcgctaatagaacaccggatgttaatggggagccaatgatgaaaatgagccgcacggccatcgcgctgagtttgctgggaatggccgcgcatcccgtttgtgccgctccgtcgtttgaagagacggcgagacaggtgattatcgcttttcagcagcgagacaacgcgaaaattaatgccctgattgataaaaaagtcgggatgtatgtgctgtaccgaattggggctgggtttgattataaatggatgaaaaaatttgatattaataaaccgatacctgactttaactacctgttggggcaggtaggttggttttcagagcatattcctgtggataaggaatttgatcaccacacggaggttgagtacgtttgtgaaaagggatgggatcacgccggtttttttgtcagctataccggttctgataatgcgctgctgacgtttagcatggtgaatggagcggatagtggggatcaggcgtcggatacccgtatagcaaacgccaggcggcttgagctgcaatcagagcgagtggtggcagtgccgaaagaatggggtgatggtttgatttttcatctgagcgagcttcatggcttgggcaaagggtggagtttaacgctgctggatttggtcacggaagattgtagtgcgtgaggcatatatgtttaatcagggtaaatggctgcttatttatatctttctgctatcaggatgttatggcaccccctcaatattcagaatttaaataaagcatttcctgaatatgaaactaattcactaaaaaataaaggtgaaatcacctcggcaacatgcattaaagaaaatacaaaaggtcatttgacttattatagcgtcagcgatcccgtctttaactaattcgggtcacgttatgtatccactatggggaatctttatatattccgaaaaaaaacacaatgatattcttaatgcagataagagagtaatcttagggtgtgcaggtttgtaaaccagggtatggcggtagcgttattttttaacgaggtatcatcagaggtagaattaacgatcgcagacgatactcagtactaagaggaaatcaggttgaggttgaacagaaaatgataaatacgtattgataagatggaatccattgaatctacttattagtagattttattatgaaaaatatatttttcttgatgttttttacgcattgcgcaatagcaaatccttgccgccttgatgcaacttgagtgattttgtgtatagtgtgacaatgctgaatactgaattgataccttctacatattaaatcagggggtagttgtatgggcgattttataaaatatctatttatttttccttgcttatggagcgcaaattcttttgcgattactcaaactcaatgggatggtaactttagagtcgaggaacttggcgagcagttaaatgataggagtcaggtttttttacaatataatttaaagatagatagtaaaaataatcgtgcttctttatccatgacaacttggcatgcggggataacatgcattggtgactactctttaaaaatcaattctggtgttttggtattatactataacggcgacgaggaaaatgcatgtccatatccatcaccgcaatttgagataagcaataaaggaaaagagtattatataaaaggaaaaatgttttcatattctcagcctggtgagtggttgccactcaaacgtattacactaaaataattctatattccataaattatgacgatgaagttaatgatggtataaaatattaaatggatatgtcgtgaacatatttttgttatatgttttcaatgtgtatgacaagaaaatttgcatgaaaacattatatgagacggtttgaaaaatgaatgaagttcacataaaagcaaggtcattctgaaacgaatttgtcaaatttgctgaattatatatcaataattactgagtatcgacaacaatgtaaaatcgagtacaaattcacggattctcttttgctgatggtttgtgcagtaattggtaggactgaaggttaggggagtatatgaagaaaacaatattgtcttttgttctgtgcttttttgtgaatttttgtcttgcagatatgcatattttaaagataaataaatcacactatatgcgctttttgccataaaaatgtgtaatagcacatcaattataaagaatagagaatatggcgggttagtctgtaaacctatagtaataaatgtattgcaactgaagctaagtagtgaagcttggttggtttttctccgtcaaatagctcttgtccttttggctcgactaaggttggtgattatcatacacatggcttttactctgatctaaaggggaatccagtattacctcaatatgaggcatatgactctttacatttttcaccgcaagatatttctgggattgcaagtgatggtataggtaatcctgattatactggctttttggggactccagataataaatattataagtttacccctggaactggaaaaaactgagggaatgaaatgaaatatattatttttgcatttatttttctaattccgttaagatgtatgagtgaaaaacttgtttttttagatgaagtacaaacaaaaactatgaatgttgctttttcacattttagagagcatacaaactggggcttatttaataccatgatacaggatgatgatgaaaatattaaaatcgcattctattgtaaatctcatctggaagaagcccgtggtggcggtatggagcaaattatttatataatttcaaaaaaagattttaaaattgaaaaaataaacaaaagttatagcaaatgaaatgatataaattgttgagtaattggtgaatattctctggtgttacccccgagcaaatggaacaagtacagcgagctattgactatggttcaacgaaaggtgtgactgtagtttttacaggagcaggaaaatgacatttatatttgatgtaaataaagagtatcacgcgggtgctaacctgacagataagtttttatgtttagaaacttattcgggattggggcgctattcttcagatcctgattacccttgtcagttattatctattgattcggatgatgtatgtatcggtcatgaattattacaagcattaaaaaatagcagaacttacaccccagaagagagtgaagagtatctttctttagagaaaacacaggtggagtatgatgagtgggtcactgtattgatggcaaaatataattatagaaccaggcgtgcattatttaaaaacatgaagtattgctcaattatatgcgtgaataatattattaagatacaacctactcgacatactaaacttgaagggtggagctgggccggacatgacaaagatgtaattagattgcctgttaccagcgaaccagagaaaattggaagtgcattgagacaggcatttgaatgttgtgattaatagcctgatgataggttatttatgtttgatagaaataagacaataaatttacaattgttgtaaggtctgattgatgttaaaaatagttatgctttttttgatgttttttccctgttattgcttacctatggatattaaaaatataaaagattgtaagttggaggaaggtaatagagttaaattaatttcattgagcactgttgatggtagtacgccatacttaatctttgacaatgttattgttagcgcatttcttgatggtagtatctattctggggacattatcctctcaaaatatatccatcactccctcatttttgcgctgaattacggcgctccttatatgaaaggctgtttgataacgggtttgagtgccagtgctgagagaagctataaacccaatggcttttgttttgcagaaagaaatattccagagtctgtctggtttggtgaagatcatacgttaattattattaaaaataataatagtgttggggaatggcgtggtaattatattatctatgatagccgtggagatgaggctcaaacatttaataaattgcctgacactaaaaattataaaatttatcgattagatttatattattgttcatgctatgttttctgggaggatcgtcaggttatgcgaattcagaaaagaacatttctaaagaacttcttagtgagtataaaaatttttcacttgctgagtgtattgaaaaaaattatgaaaaaatgggcgttgtttttactaagctacctttaaaagataatacaagaggatttatcgatttggatatggggcttgctttttatcgggataaagataatgttttagcttcatttatagaaaataaaacgggtgatttttataagcccaggcaggcttatggtgatttggcatcggtaaacatggttatatatgactgtatcgatttttatcattcaaaagaattgaatatatttttacgtaaaataatttctgaaagaaacattagaaatgagaatgattaacttaaataaaatgtttaattaagtctcaaatctattctatttcacccgaaatgaataagatatatcagatgtataaaaagatagtaatattagtgattacgcttattattatatttttcggcggtgggtggtatatgcataaatcacaacaacaaatggcaacccttgttatttctgatagtgaaaatgccctcgattatccgaataaacgtaaatggtttgatgccagtagatggctcagcacatcacaatatattaaaatagatgatttttatcttttaaatcttaagcatcatccagttaacaatataaatgatgcagggattattgtaatattacactttgcaattcgggatgcgataaagaaatttccagagttatcaaaattaagccagatggataataaggaattttttcatttcatgcagaataaactttctaacgagtatcttagaaccaaattcaatgaagatacactggaacctactgatgactattttttgttcttttttacttataatgaaatatcttatgaggtggaattattacggaaagttactgagcatggtatgatgtttgtgccttatggatatcaagttaataaaaaaggggattggcacagaatgcatccatctacatattcttgttttaacgatatccaaagtaattagtgagacgttacgaaagctttttaacaccatggatgatgagtcgtttaatgtcgcttttgcagcatgtagaagaggagttaataatcctgtctgatatcggaggggttaattgaagtatatgaagcatttttttctaatcctttttgggatttcttctccatttatatgtttggctacttctgttgaatttaatgttacaaagggaataaaagcatcaatcacttgggtggataataaaaaagttgagtatgaaattacaggtagtgatcgtgtggcaaagagaggatattatgatgttgatacggaaaataatatccatgttaaatatggtgattataattttgatggtaaagaagattttgtgatttggtatacagatgatggtatgggaatttatgatatatatagggtttttctctattctgagaaaatggctgactttaaagaaataaagccatcatgtggcgatgattttataaatttaaatctgaataagaagaaaagagagcttattagtctgtattattctcataatgaggcgcaaagatgtattactaatgtttttgttggcgagaataaattaaagtgacaagtggtggtcttttatttcaggagatgattaattgataattattttattctttttgggatgattattggttagttctacttatggtgaagaaaattataaaaatattcattttaaaaacgcaacgataaatattcctgccagatgggtagctaataaaaaagatgattgtttattgattagtaaaaatcatataaatgtgttcagttatctttatgtatgcacagatgcggcaacgaataaaaattctttttttacaaagaatgatgatggagaatgggaggccgttactgatggcgtccctgttttagctgatgtaaatattacgccaaaatttattggcatgagtgcaatcgtttcatgtaggtacaaagatgatgctgggtatcatatagaccagtgctttcaggcagtgatagtattgtcaacaaacataatgtttgtttttattggtagaggcgattcatccttatttaataattataaggaaatatatcgctcattcaaggttaaatagcatgtgattaattgatggggattgggtgaatgtttttcattaattacgactgtgtgatgcttcataatgagcagactggatatggaattaatcaatcgatgagaatatactttagatgaagtggataattatggttttagttttttctttttctaatgtttatgctgaagactgttcacaacaagactttgataaagcggatatggcgttagactctcttgcgtcatggaaagctgtcgatggcttttattcccgacatagtcaatgtgatgtgggctacctccgggaaggcacgtcagaaaaaattatcagattgttagtggatagatggggagaattgaatgagttatctgcgcttatcaaaaggaaaccagcacttggcgattatgttattgatcatattggagagatactcgatgtaaaagatgttgaaaaaataagggattattcagcatctcattgccaaattgatagtaaagatctatgtaaaaaactgcacgatgcagctgtttatattttaccgtacatgtcttctcagtatcaatatcttaataattgacgcttatttagcaatcatatcatgagtttttaattgaaaaatacaacaatgcatgatgacaatattttattatatagctttcaatatataacccaatattaatgccgattatgaataattatagattaactttttctttatgtttactgcgttcggccatattgtttggcattattttaataagtgttaattgtaataatcaaaagagtaaggaattggttcttcctgttgattccacgcagtttacacaattggcttgttattataaagatattaattccgatgataatataatggagttaaaattaccagatgaatataaagagaaaactaacttatttaatcaacaggaaattaaggtgccggtaaaaggtgagagttttctttctccgtatattggtgatggtgtccgttattatgaattagggtactttgaacatgatggtaatacttacaaattgataatttataataaaattggagagtctgatacgttattgcttaatgtacaaataaatagttatgatgcaaaaggaaacctggtggatgctttattgcttagtagcttttttgcttatgaagacatcgtgcgtttttctgattttgtcatccgccaggattacacaataagcattgatagttatgttatatacaggtggtatgaggacagcaaagatggtcatcttgtaactataaagtttaaagatcaggcgcctcagatttatataaaggaacaatatcaaatggaaaatggtcgattcaaattgatatccagaaatgcagtatcacagggtgaaaaaagaagcgagcgttaaatataccatgcttacgacattaataattgtaatggaggtgttaagataatatggatagcaggaaagaatgaggaacgttatggaaattataaatagattgttaatttcaactgatctcaggttaatcataaaatttcagtttccgcgccagatttattcaacgcgcagatagtgcccgtcggcgcggacatttgcgccaaaaccgcagtccacaaacgtatcagtgctggcatcaatggtttcagaagaaaaagccagcgaaatgtcacagtgaatatcatcgccttcccgaagcgccacgatggctttatcgttttccagcgttatctctgcgtagaactcgccgatattggggccgaagtagatccccattaaaccgaaccagtaaccctgaaaattaacctgatagcgcgatggggtgggtaatgccttcacgctaagcacgttccaggaggcgcgcccggcatagcgccagtattcacccgccgtggaaaccggtggcggcaggaccgatagcttatctttgatcagtttcaggttgtagatcgacttgctatcattcggccttagcatcagccaggcgcgggctttacgccactcgccttcgcgtatccaggttagcgccacgttgttgtaggccgtcgcgatggcgttgtcgtcaagggcgcagctttcgctccatgcggccagctgttcaaaagcgtcgagtgctttggcatacttttgggtcttgtaaagctgttcgccctggctggccaaaactggaatttttgcgcagtcggcctcgatctgctgctccgtaatttcagccctggcggtggcgaagagtagaagcagggcgcaaagaaatagagattttctttgtattatcactccattacaccattgagttgacctgtcccggcagctctgaattcgggatacggacggtataccaggcgaaacgaaagcgtttccagaaagaatcgaaatgcaggtggtccaggcaatccataacgatttcattatccgggtaaagcgtgaaggcaaaatgtgcccagcgtgcgcttagcttcatattaaacagcgttcgatcgtgtttattaccgtgcaggcgcgatagggtcaccatagcgtgtagcgtgcctttgttggcctcttgttgcaccagttccagatgcttatgcgccagcgtaatatccttcacttcaaaaatattcagcaggaacaagccccaggcctctttatgcccgaactgatgcgccagccagagattatcgagcagttctttttcataagcggaacgtttttcggtatcaagttcttgtttactcagacgctggttgcagatgccgatgctgaaatgaatattttgcaggtcattttcatagtcggtatagcctccgttatctattaatttgtacggggtgctctcgcgcagcgctaaccgccggtgcaaaatctccgccgcgcgctgaaaataccctaacgcgatggcaggatcgtaaggtagtaggccgttgttctctttattattgtgttcaaggcccagcaggtttagcgcggcgggtatatttctttgtgcgcccagctctgccagcggcacaaaatgttccgggagcccgaaccagtcgaaatttttaatcgccgcccgccagttatggttatattgaatgtcggcgacgctatcgagccaggcgaggccttgcgcctcatccttttcgaaacccaataacccggcgtactgaaagtagccacgacggattttcggcactgcgaattccgtttgctgcgcattctgacagagaaaattatacatccaccaggtgtcaggaaaatcgcgcagggcgaactttatcgtgtcatcaaagaagtaattgttgaacttaactttttccacgatcgaacgctgaagggttcgccagagcgcgtcattatcgtccagatcgctatagcagacccgcagccacttcagcgtgttgtggcgagattcctggatatgcgctcgcaggctaatctcttcggctttggcgataatgcgttcctgttctgccggggagtcaacctctttgatgcgcagatcgcggtgatcgtcccaccagatcaatagctccagatgttcacgttctgcggcagaaaggtgatcgcatacgcttgattccagaaattcgcggatttcctcgtgagaccctccccagcgcggcatacgaaacgggatatattcatccagcacgtaaaatgccgtcgggaaaatagccaggcagacggcgagccagtatttttgcccggcatcgtcattgcactccggcagcacggacgggcgcggcaaatttgggcaaaccgcgtcggcaaacgacagcccggaatgggccatcagcgcatccacctcctgcggtgaatggcgatgatattcagccagatcttccattaatggctgcccggcaacatccgcgccctcgaggaactcaaccagccagtcgggctggccgaagacttttgagttggtgctggtcagggccgccgccatccactggcgcggttcacagtcgatagcattgagcgcggcgatgaccatccgttcgttgcaggcggcggcgcagatccacatcgctcgggtggtttctctcgcccagccatagctgcggtaaagccacgcacggtgattccagtattgcgcctcggcaagccaggcgtgagtggagcggggacgagcgcgctgccagtttttgatcagcgctaatccttgcggcccagcctcaaccagcgtgtccatatcgtaaaaagggttgtccatttgattccaggcgaagaaatagcgcttttccgcttcgcggctggtaaagctctccgtcagcgcctggttgtagcgttcgtccagttcgtcatagcgttcttcgcgcagcaggccgggaatatcggcgatatgccactctcgttgcccgtcattgaggggatttttgtggttgcacatctcaaacatagcgttgagcagacgatcatcctgttccataaatagtcctttaaatcggctcgaaaattttgaattcattccacggcagttgtcgccagcggctgacagggtcttgcagataatgggtggcttcctgtaaatcccgtccggcaagcgctattggcgtgtcacgtagcgtgagccatacccggcgggcgcgaacgtaggcggtggcgtaatcctcccaggaatcaaaacagtcctgagcgcgctgggcgttaagtaataacaccagccaggcctcgttttcgtcacaccagccgagcccggcgatacagcgggtcagaaaggcggttcgcatgcagtcgaaagccagcgcgtcgcggacctggccctgggccgccagatgatgataaaacgtgctcggcgagctgccgatgcccgcaggccagcggcgtaagatatcctcgaccttgtggcgtaacgccgcgccgttgaggttttcgctcaagcccagctctttttttacctgctgtgccagatagcggtgtttgtcatcgtcaagtttgaagaccagctcaacgcctttgatcggtagcccgttgcgccgggcgaggatatcagctagcgccagcgcccattgccgccgtcgggtatcgcgacgcagatccttcagacgatctttttctttctcctcggcgatacgggccgcaatcagcggtttgtttttttttgtagttgcgccagctaaaaaatagggcggcaataataagaacaatccagaacattattgcacctccttgatgacagggaggtaacgcgtggtttgtagcgtcaggctttcaatttcgaaaggttcactactggtgtttttcccggcaagcgtagggtgccattcatgccgtggaaacagcatttccgcagccgtcgccacgttaggatcaacaacctgaaggtagcgcagcgcctccggggcgctgtgcagcagcagccactgtaaagctaccgggggagtggggaagtgttccattaaatgaaaattgtcatgcagcacattgagcagaaaattgaggtcatgaatatgagtaataaatttccaacctgaatattccggcgtcgattcataaactattcccatcccttcgcaatcagcgtggcgctcaggaagtggttgcagatggcgtaacagagataaaacatcgttagcatatttcttaataggatggcgattttgcttacctttaatctgatcaatgctcaggccgttattaccaaccaccaggcttattgtgacgtggggaatattattgccgtcgcgcaggctgaacaggcgaagtttctgttgttcaatttgccgggcgtagtaatcgccgtagccgccggaaagcgcgcctttattatcaaaatctccgacgcagtgttgcatatgccaggattcatacgccatctcactgcgcaggccggggtttgttgcatcaagctcaaccagcacaccgttattcaccgccatcaccggttttagcgcctcgctgttggagggataccaaccttgttcacgcaggtgctgcattttttgatgctccgcttcgcgcattgccagcacggtaaagcagttgatgcgctgtagtttagtttccagccgcgttccttcctgacgcgaaagaaattccactaaatctctttccattgccacaagttgcgggtgctgaacgttaaggtagtaaaagcgctcatcgccacccaggcggggatttctgcatcagggctaaaataaacggcataatcagcgacggagcgcacagggtaaacgtgaggaaagtcaccaatgatccaacgataaaaatgattgcttaaccagcgctggatattttcgctatcgccgcgttgttggctccgggaaaaaatagatgattttacatttggcgcatttattatattgcgtggtttatagcggtgagatgacgtttctgtcataaaaatccatgtgtaattaagctggcattatgtttatgtatttttagattcacttaatgaattaatgcgcaataagtttaaaaaactactcacagtatatcggtaaactaaaaagagcggccaaataatttattgtccccgatcgcgttcgtcgtggttttcgggataccgctcggccaaatgaaagagggcagtgtgttaattccgccagaatagcgttggcggaaaatatcgtcttacgaccttgttattgttatgccaataatcattataccaggcgacacgcatccgcttcccagcgatatcccaccccgtagaccgcgcgtataaatgactgttcggcatccagcgattccagtttacggcgcaggtttttaatgtggctgtcgatagtacgatcggtcaccacacggtagtcgtcgtagaggtggtttaacaactgctcgcgggaaaaaactttacccggttcaagcgataaggtttttagcagacggaattcagcgggggttaaatccagcgctttaccacaccaggaggcctgaaagcggctttcatcaatcattaacgggctttcggcatcctgctgctggagttcgcgctgcggtttacagcggcgcaaaatggttttcacgcgggccacgacttcgcgtgggctgtaaggcttacagatataatcatcggcgccgatttccagcccaagcagccggtcgatctcttcaattttggccgtgaccatcacaatggggatgtcggaaaaacggcgaatctcccggcatagcgtcagaccatcgatacccggcagcatcagatccagcaggatcagatccggcggcgtttgacgcacatacggcagtaccttgtcgccatgattgatgagcgtgggggcgtaactcgccgcgcgtaagtagtcaataagcagctgtcccagcttgggttcatcttcaacaatcaaaatgcgcggcgtgttttcatcaatgggtaattcagtcatacttctctctgtaaatcgcgatccagcggtaactctactgtaatgctaaccccgccaaaaggcgaatgagcggcgtgaagatgaccgttatgcgcgtgtacaatattgacgcatatcgccagccccagtccagaaccgccgctggcgcggttacgggacacttccgtgcggtaaaaacggtcaaaaagcttttgtaactgctcatcgctgacgcccggtgcagaatcggcaaaggtcaggaataatgatttgtcgcgttgttcggcggaaatatgcaggccgccgccgctgtcggtgtagcgcagactgttttccagtagattattaaacagttgcatcaggcgatccgggtcgccgaagacggtcatactatccggcaacgcgtaatgtagcgttagcccccggctggtaaagcgttctctaaacgcgccgccagcgacttccaactggggaacaagatcgacggtcgttttttggtaagccagcgcgccctcgtcagacaacgacagctgatgcaggtcgtcaaccagtttggtaagcgtaccgacttccgcctgtagcgaggtaaccgattctggcgtgaactggcgaacgccatcctgaatggcttccagttcgccgcgcaataccgccagcggcgtgcgcagttcgtgggaaatatccgccataaagtcgcggcgcatctgctgatttttttccagcgtgctggcaagctggttaaagtcttgcgccagttttcccagctcatcggcgctggttggggtcacgcgcgtggtaaaatcccccgccgccagcctgtgcgtaccctcgaccaaccgtttgaccggggcgagcaggccacgcgccagcaaaaacgtcgccagcgcggccagcaaggttgataacgccacgatcatccaactggcacgccgctgctgcatatcaaaattaatatccgtattgcgcgtcagccgctcgacaggagaggcgataatcgcgcctacttcgacgccattaaccagaatggggcggcgagtaccgtcatgcggcaccggaccgcgtgggccgaccagcacccggccattttgatcgacgacccagaactgggtgcgccaaccgtgcggcggcataccggggccgggtttatcccggtcgttgtcatgctcaaatgaacgcagaatctggaaaacgaagcgatcattgttacgtaaaaaacgccagttgccgtgttgctggtactggtcgcccagcgcatcgcccagcatttgtagccgctgctcgttgccgtgtttgatatagtcaataaatccgcgttcaaaactgacgcgcacggcccaatgcatactgatcagcagcacgatgcaggtggcgaaaatcgccagaaacagcttgccggtgattccgggccgccagactttcattacaggctccttttacgccgtgaaatgaccatgttttgctgtgtatcgttcggcacgcgggcaaaaattatcgccggtagcgcgataataaccgccatacataaccaggtgtacataaagacgtgatgtgtggcgctactgtctatcccgatatgctgttggccaaacatacccagcagcattccggcaatagtgacgccaatactcatcgagagctgcataatcatcgataataagctattgccgctgctggccagcgtatcgggaaggtcttttagcgttaaggtattcatggaagaaaagcgcgccgagttcaccattccctgcaaaagcagtaccagcggcaggagataataccagccgagcagcgcgaccgacataaacaacaggctaaccaatgccagtccgagcgtggtcgctaccagaacccgacgatagccaaaacggttaactatctgcaccacaatccgcttcattcccatgctgcccagcaccatggggatcatcatcaaaccggcatgaaacggtgaaaaaccaagaccaatttgtaaaaagaccggcgtcataaacggcagcataccgctgccgatacgcccggcaaaactgcccagcaaccccagtgaaaacgtgggcgtgcggaacaatcgcaggctgaataacgcacctgagttttttttggcatggaagagatagagcagaatggctgccgcgccacccgcagcaagtccggctaatgtccagggcgaaatccccatgcttttactaccgtccagcgccagcgtgagtaccgccatgccgatagctaacagcaggaaccccggcagatcaaagcgccgggtctctatggtgtagtttggcatcagcataaaggtcgccatagcgccgacaattcccaccgggatattgatcagaaagatccagtgccatgaagcatattccaccagcaccccgcccagcgcggggccgagtaacggcccgatctgtcccggtagggcgacgaaggtcatcgccgccatatattgcgcacgcggcacgattttcatgaccgtcaggcgtccgaccggcaccatcatcgcgccgcctacgccttgtaaaactcgcgctaataccagttgattaagcgtaccggagagggcgcaaaacagcgaacccagcgtgaacagcacgatggcggcaaagaaaatattacgcacgccgattttgtctgccagccagccgctggcggggagcatcacggcgacggtgagaacatatgacaccactaccatgtgcatatgcagcgggctttcccccaggcttttcgccatggaaggcagcgcagtgttgacgatggtggtatccagcgactgcataaaaaagccgaatgccacaatccagagttgccagcgggtgttgtcaggaaattctgtcatatctctactaccggtttgctatttttacgcgaaaaacgcagccgcagacggtcgaaaaagaggtacaccaccggcgtggtatagagcgtcaggagctggctcatgaccaaaccgccgacaatggttatccccagcggctgccgtaattccgaaccgtctccgccagataacaccaatggcagtgcgccgaacagcgccgccagcgtggtcatcattattggacggaagcgtaacaagcaggcctggaaaatggcttgttccggtgtcaggccgccgcttcgttgcgcttcaagcgcaaaatcgaccatcataatggcgtttttcttcacaatgccaattaatagcatgatccctatcagggcgattaggctgaaaggggcattgaagagttccagcgccagaagcgccccaacgcccgccgatggcagagtagagagaatggtcagcggatggacgtagctttcgtacagtatccccagcacaatgtagacggtagcgatcgccgccactatcaaaataagctgtgaattcatggtctgctggaagacttgcgccgttccggaaaaactgccgcgtaccgtcgaggggacgccaagctgcgtcatggtgcgatcaatggcctccgtcgcctgcgataacgatgtgccggtcggcaagttaaaggcaatcgtggacgctgcggaaagtccctgatggtttaccgacagcggcgcattggcgggccgccattgggcgaaataagagagaggaatcgcttttccgtcgcggttgataacgaacattttctccagcgcgctgatatcctggctatagcgcggatcgacttccatcaccactttatactggttcatcggctgataaatggtggaaatttgccgctggccgaaagcgttatttaacaggctgtttgcggcctgaacatcaatgcccagccgtgacatggtgtcgcggtcgtagataaggttcatctccgcgccgttatcctgctggtcggagtttacgtccgccagttgcggcagggccgagagcgctttgcgtattttcggctcccactcgcgcagcgccggcagggagtcagacagcaacgtatattggtaactggcgttagcctgccgcccgccgacgcgaatatcctgtaccgccatcagaaacagcttggcgccgggttcttttgccagtttgacccgcagtcggtcaatgacttgctgcgccgtctctttgcgttcgccgcgcggcttcagcgtaataaacatcatgccgctattcaccctcgatccgccggtaaaaccagtgacattattcaccgccggatcgtcgcgaataattttcataaaatcctgcagcttgccgcgcatggcttggaaagagatgctctggtcagcctgaataccgcccatcaacacgccggtgtcctgctccggaaagaatgttttagggatggcgatataaagccagatgttcagcgcaacggtgccaagaaaaaccacaccgacaagacgcgtatggttaagcacccattttaacgacgtgccgtaaccctgttgcaaggcgaccagcaaacggccaacgccccgtttacgcggttgggtgcgcggtttgcttgatttaagcatccagccgcacatcatcggcgtcagtgtgagcgagaccaccagcgaaatgccaatcgccaccgagagggtaacggcgaattcccgtaataatcgtcctggcaggccgcccattaacagcagcggcagaaataccgccaccagcgacagactcatggagatgaccgtaaacccgacttcccgcgtaccctgtaatgccgcctgcaaaggtttcattctcgcctccagatggcgggcgatattttccagcaccacaatggcatcatcaacgacaaatccggtcgcgatagtcagcgccatcagcgacagattgttgaggctgaagccgcacagatacatggcggcgaaggtgccgatgagcgaaacgggaacggcgacggcggggattagcgtggcgcgcccggaacgcaggaataaaaacaccaccaggatcaccagcgcgacagagatagccagcgtctcttctacctcttgcagcgatgcgcgaatcgtcggcgaacgatcctgggcgatttgtaaatcgatagcggcggggatcattgcccgcagttccggcagttttgcccggatgccgtcgaccgtctgaataatgttggcctccggcagcttgcggatcatcaacaaaatagcgggtttagcgttcgtcatcccggcgttacggacatcctgcaccgagtcggtgacgctggcgacgtcacccaggcgtaccgccgcgccgttgttatagtgaataatcagcggctgatattcggcggcggttttcagttcgtcgttggtctggatttgccagcggtggacgctatcttcaattgcgccttgcggtcggcgtacgttggcgctgtcgatcgcttcgcggacctcatccagcgagacgccctggttaaagagcgcctgcgggtttaagcctacacgtactgcgggcagggagctgccgccgacgtcaacgtcgccaacgccgtcaatttgcgcgatggtttgcgccagttgggtagaggcgaaatcatacagtttgccctgtgaccagctctctgaggtgagcgttaaaatcataatcggcgcgtcggacgggttggccttgcgataagtcgggcggctgggcattccgcctggcaacaagctttgcgcggcgttaatggcggcctgcacgtcgcgcgccgcgccgttaatatcgcgatcgaaattaaattcgagaataatgcgcgtactgccgagcgagctgctggaagtcatttcattgacgcctgcaatgcgtcccaaagaacgttccaacggcgtcgccaccgacgaagccatggtttccggcgaggcgcccggcagcgaggcgctaaccataatcactgggaaatcgacctgcggcagcggggcgaccggcagcagacgaaagcccagaatgccgcacagcgtaatggcggcggcaatcaaaatggtggcgaccgggcggtagatgaaaagggcgaaaaagcgcatctacgcctcctctttatggcgcggaaagcgacttttcacgtacagcgacaggcggtcaaacaggagataaatcaccggagtggtaaacagagttaatacctggctgaccagtaagccgcccaccatcgcgatccccaacgggcgacgtaattccgcgccaacgccggtactcaacattaatggcaatgccccgagcaacgccgccagcgtggtcatcagaatcggtcgaaaacgcagcagacaggcctggaagatagcgtcgcgcggactcatcccctgttcgcgttcggcggcgagggcgaagtcaatcatcatgatggcgtttttcttcacgataccgatcagtaaaataatgccgataatggcgataatatcgagctcgctaccagcgatgatcagcgccagcagcgcgccgacgcccgccgtaggcagcgttgagagaatcgtaatcggatggataaaactctcatacagcacgccaagcacgatatacatcgccaccacggcggcgacaataagccagacggtgctgcccagcgccgcctggaaggcgagcgtactgccctgaaactgcgttgtaatatccgctggcagggcgagcgttttttccgtatcgagaatcgcctgcaccgcatcgccgagcgaatagccctccggcacgttaaacgaaaatgtcgtaaccgggaactgatctaaatgattgatggagagcggggcgaagcgctgctcaatgcgggcaatcgcgctgagcggtacggtgccgccgtcgcggctcgtcaggcgaatcgtctccagcgccgccagacccggcgtgctggcggtattatgttccagcacgacgcggtactggttcgcctgggtataaatcgttgaaatcaggcgttgtccgaacgcgttgtagagcgcgttatccacatccgccatgctgatacccagacggctggcgctgtcgcggtcgacattcacccaggccgctaatccccgatcttgccagtcgctgcttacctcagagagctgtggtaacgactgtagcgcgttctgcagttttggcacccagtggctgagcgcatcgagcgtcgtggcctgcagggtaaactgatactgcgtgcggctgacctgcgtgtcgatggttaaatcctgcgtcggctggagatacagcgccacgccgggaatcgtcgccacggcggtttgcagccgggagatcacctgctgcacgcggtcatcacgcgcatccagcggcttgaggttaatttgcaggcgcgcgctattcagcgtgggattagcgccgtctacgccaacaaaagtcgtcaggctttgcaccgccgggtcctgtaatatccgctccgccacctggcgctgacgttgcgccatactggcatacgatgatgattgtggcgcctgcagcgtcccctggataatgccgttatcctgtaccggaaagaaccctttcgggatggttatccacagcataacgctgagcaggagcgtggcgaatgccacgctcaatgtaagccatggatggttgagcactttcgctaatccgcgtccgtagctggcgatcacgcggtcaaacatccgctcgcaggcgcgggaaaagcggttttgtttacgcagagactgccggctgagcatacgcgcgcacatcatgggcgtaagcgtcaaagagacgacggcggagattaaaatcgctaccgccaacgtcaccgcaaattcgcggaacagtcgaccaacaatatcgcccataaagagcaacgggatcagtaccgcaatcagggaaaaggtgagggaaataatggtaaagccgatttcgcccgcgcctttgagcgccgccgccagcggtttttctcctttttcgatgtagcgcgagatgttctcgatcaccacaatcgcatcgtccaccacgaaacccgtggcgatagtgagcgccatcagcgtcaggttattaatggaaaaatccaaaaacaccatcactgcaaaggtgccgataagcgacagcggtacggcgacgccgggaataattgtggcgggaatattacgtaaaaacagatagataatcatgacgaccagcgcgatcgccagcatcagttcaaactgggtatcgcgcacggaagcgcgaatattggtggtgcgatcggacaggaccgtgaccttcaccgatttcggcaggctttcggtaagctggggcagcatctggcgaatgctgtccgctgtcgcaatgatattggcgccgggctggcgttgaacgttcatcacgatagccggagcttgattcgcccatgcgccgagccagctattttccgccccctgttcgacggtggcgacatcgcccagccgtaccggcgcgccgttttgatacgcgatgataagcttgcggtattcgtcggcagactgcatctgatcgttagcagaaagcgtcaccgcccgttcggggccatccagactgcctttcgccgagttgacgttggcgccggtaattgcggtacggactgtttcgctggtcagaccgagcgcggcgatagcctgagcattcagttttacgcgtaccgcagggcgctgcccgccggcaagcgtcaccagcccgacgccggagacctgtgagatcttctgcgccacgcgggtttctaccatgtcctctacctgggtcatcggcatcgcgtttgaggtgacggcaagcgtcataatcggcgggtccgccggattgactttgctataaatcggcggattcggcaggtcggaaggcaataaattggtggctgcgttaatcgccgcctgtacttcctgctcggcaacgtccagcggcagcgtcaactgaaactgtagcgtcaccaccgatgcgccgccggagctttgcgacgacatctgcttaagtcctgacatctggccgaactggcgctcaagcggcgcggtgacggaggaggtcatgacatccgggctggcgccagggtagagcgtaaccacctgaatagtggggtagtcgacctccggcaaagcggcgacgggcaggaagcgatagccgataatcccggcgagtaaaatcgccgccatcagcagagtggtggccacggggcgcagaataaacagacgcgaagggccgcccgtgctgcccggaggtaatacctgcatcaggcgcgcgctcctttttgaccttcatggcgggaaggggatttttcatccgccatggtggtttgcggctcaacgacctcgacttttgcgccttccgtcagccgatcaataccatcggtaacgacgcgatcgcctgccgacaatcctgcgctgatcaccacgtttcggttatcctgaataccgatttttacccgcttcttgctgacgttattttcgtcgttcagcacccacacaaagtggccctcattgcccatttgcaccgccgcggcaggcaccacaacggcattttgttcggtatcgaccagcatccgggcgttcacaaattgattggggaacagcgtatcgtcctgattggtaaagcgcgctttaattttgatcgttcccgtcgtgggatcaatctggttgtccagactgagcaacacgccttcgctcaatttgtgcgagttagttcgatcccaggcttctacgaccagcgttttccccgctttctgtgcctgaaccacggtcgcgatatcgctttccggcagagtaaaaatgagatcaatcgggtgcgtttgcgtaatgacgacaatacctgcggtatcgctgctggaaatctggttgccgacatccacctgtttcagacccacgcgtcccgagaccggggctgtgatacgactccagtcgagctgtagctgcgcgctggcgacattggcttcatccgctttaatggttccctgggtttcgttgaccagcgcctgttgcgcatccagttcctgacgggaaaccagattggttttggccagttgctgatagcgcgccagatcacgacgcgcattcgccaacgtagcgttatctttcgctaactgtccctgagcctgcgccagggcgaccttaaactggctgggatcgatttgcgccagcagatcgcctgcgttaacctgctgaccttcctgaaagtgcagggcgatgagttgaccatccacgcggctacgcaccgtaacggtattcgctgcggtcacggtacccagcccgctcagatagcgcggtacagcctgtgtggtcgcggtcgcggcctgtaccggcgccagagggccgtcgcgcataccgcggcgacctgcggcggcggtatgctgcgcttgcgcggcgacgcccggcgcggcggtcgggctttcgctacggctatgccagaaccagaatgcggcggcggccactacaaccccaatcgctattgcccagcggaaagtattactgcctttcatcggtataagtttctcatcctgaaacgttttgcggaatgttgcttcctctattgtagtcagcagggaagggagaaaaatggaggaattatggaacacggtcgggattattctgaatggcgacccgctttgcgaggcgctacgcaactctcatcggtgaaaatcgttaacgcgccggagtgcggtaaagtgccggcacggcaatgaagataagccaccgatttcagcaggatgctgaaacgggaaagcccctcccgaggaaggggccaaaataaggaaagggttatgatgaaggtagtcatcataatggtgatactcttagtgattagcctaccagcttactaagacaccagggggaggaggaatcctcccttaccctcactcctgacgttaagccacatcaagaataatgtcaatccatcagcgctgggcttgcgaggcgcttagcggaaaacgacctccgcccagcgcgccagtcctgcggtgacggagccgaaatcatcgccgccagcgacgggtatgcccggtagctgttcggaaagcgcttttttaatcaatggcgaacgggcgctgccgccggtcagatagatgacatccggtttttcctgcgcgctgtccagcgccagttgcacctgttccagaatacgcgccagcggttgatccagcgccgcttccagtccttgctggctgatagcgaccgccaggtcgtcgctgataaatggcagcctcgccgtaacatccgcctggccggaaagggcgattttgctctcttccgcgcagcgtaccaggcggtagctaagccgctgacgccagaccttgagcagcaacgcgaccttgtctgcttcacgcgcgttgcgaaccaaatcgttcaacagacgaccattcgcgctactgtaaaaatcgctttgcgccgggacgtcgttaatcgcgacggcgttccaccacggcagcaccggcagggcgatacctttttcggtttcgccgcccatgcccagcaaaggcatcagatttttaaaggccagcgcgatatccagatcgtttccgcccacgcggcaaccgctgtgccccaacaggctgttttcacgatcggcgcgctgacgccactgcggccccatcagcagcatggaacagtcggtggtaccgccgccaatatccacgaccagcacacgcttctcttcccgcagcgtagcctcgtagtccaggcccgctgcgaccggttcatactggaataccacctcctgaaaaccggcgcgttttgctgcccgctccagaataccctgcgcctggcggttcgcgtcatcgccgccgagtccctgaaagttgatcgggcgaccgatcaccgcctgagtaatggcctccggcaattggctgtgcgccgtatgaagaatatgtaccatcatggcgcagaccaaatcttcaaacagcgcgacctgctgcggtttcaggccgctggcgcctaaaaaggatttcggcgatttgacgaaccagacttcctggggatcgtcaatatagtgcgccagcgacgccagaccaaactgtacgctttgcgcgccaacctcaatatcttcctcgcggttgtagcgtatagcgcggcgtagcagcgcctgggtttcttcgtccgttgccggcacatcatgatggcgatacagccactcgctcaccgcttcgcgcgtcggcgcacacagcatagacggcagtaatgcgctgttattctccattgtcagcaactgtggatgcccgtcgcgcataatggcgaccgagcagtttgccgtaccgtaatcaaatcctataaacaccttaaaatccccatgccagtgaagaaggggcgtgactttagcgaaatgtcgtcgcggcgacaactggaatatgaaagcaaggcgttacgtgcgattagcgtttatgctgaaaggtcaaataaaggagaaaagtatgtttaccctgagctggcagccgccttacgactggtcgtggatgttgggctttcttgccgcgcgtgcggtggacggcgtggaaacagtaggcgagggcttttatgcgcgcagcctggtggtgggcgagcatcgcggactggtcagcgtgaggccccatctgcccacccacactgtgcaggttagcgtgagcgccggattacttcccgtcgcgccggcgtgtctggcgaaagtttcgcgtctgtttgatcttgactgccagcccgagcaggttgccgccgtgctggggccactgggcgaggacagaccggggctgcgtttaccgggatcggttgatacgtttgaacagggcgtgcgggcgatactggggcaactggtgagtgtcgcgatggcggcaaggttgacggcgaaagtggcgcgccgctatggcgaggcgttgccggatgcgcccgattatgtctgttttcccggtccggaaacgctggcgttggccgatccgctggcgcttaaagctctggggatgccgctgcggcgcgccgaagcgctgattcatctggcgcaggcgacgctggcgggaaaactggcgctctccgcgccgccggatattgagcagagcgttaaaaatttacaaacatttccgggaattggccgctggacggcgaactatttcgccctgcgcggttggcaggcaaaagatatctttttgcccgatgattacttaattaagcagcgcttcgccgggatgacggccgcgcagatccgtcgctacgcggagcgctggaaaccgtggcgttcctacgcgctactgcatatctggtatacccacggctggcaaccgtcaatggatagcgaaatagctggtattcagtaacaaatccagcggttgcgcttcggcgatagtgtcgccataaatcagatccacgccaatacgggagagcgtatccagcacctgtgggttttgtaccggcccggcgagcgttttgatgtccagatgctgggcgtgtccctggatgatcgaggtcagcatttcatccattaaactttcatgaacgttggcgataaggtcgctatccagcagtaaataatcgacgatatgcgggggcagtaaattaaacagctgtaaatcgcgcccgacatggctgagaatcacctggcagccgcgttgccgcagttttcgcagagtcgcagcggcggtctgcgcctgcttaacgataacgtcagccgggataatcaggtgtaataaccgtggcggcagtgggctatgctccagttgttccagcagctcatcaataagggtcgcgctgtataatcccgcggcggacagcggcagcgcaacgcttaatcccttgctggcgacggcggtcgccgcatggcggaaaaactcatggaatacccgtcggtcaagcgcgtgatgcagcgcggagtcggctaaccctgcccggaacgcgcgctcttccatcacttccccttcgctggtccacagcctgagtgagaccagccaaaagctggtggcctccggcgtacgcggcggcgcgacgtttctggcaagcattagcaggaggttatttttaatcatatgccactgttcttccagcggcatcattccctttgaggaggttaatgcgtgctgcggttcgtacacggtcagacggcctcgaccgctatttttcgcggcgtagcaggcaatatcggcctgagacacgacctctgtgagctggcagttatgttcatttatcattgtgatcccggcgctggcgccgatccgatgcaggcgtccttcccacataaagtgatattcattaacggcgttgataagccgcgtcgcgataaagcgcgcgctgtcactattacaatccggtagcaacaggccaaactcatcgccacccaggcgggccaggagatcgccggagcgaagcatactgagcatcagtgacgcgagctcgcgcaataaggcatcgccggcggcatgtcccgcgctgtcgttaaccgctttaaaacggtccagatcgataaacaccagcgcatgatgttgaggcgattcctgtattgtttgcaggcgctgttgcagctgtttttcaaaactggcgcggttggcaagttgggtgagggcgtcatgcgttgcgctgtagctgagctggcgtaacatttttcgtgattcggtaacgtcctggataaccagaaccgaaccaatcttatcgccgtcaagcgtactgagcggcgtgatactgtaatgaatatcgtagctaccgccgttatgacaatggagcactatctcctgttccatgtccgatcgcgacctgttggcgcgataaatatcctccagcagcggccccttattacctgacgtaatgcgcagaaccgttaataatggcgcgcctaaagcatcctcttgccgccagccgctcatcttctcggcgatcggattcataaaggtgatattcatcgcgacatcaatacacaccaccgcttctccgatagagtcaagcgtgatgtgcaaccgttctttttcctgaaacagcgcctcgttcgcctgtgtaatacgctccatcaaccgctggttttcctgctcgctttgcttgagatcgttaatatcttcaatctgagcaataaaatagagaggttgattgtctttatgacgaaccagcgagacggccagcagcgcccagacgacatcgccgttgcgggtgtagtagcgtttttccatggaatagctgttgatgtcgccgcgcaccagcatgtttagctgttcaaggtcgttattcaggtcttccggccaggtcaattgctgaaatgtcatcgtgcgtaattcatcctggctatagccaagaaaatggctcagagatttattgacctgtagccactgaccctccgtaccgaccagcgccataccaatggcggaatactccatcgcgttgcgaaagcgggattcgctctcggtgatatgtttgcgctccgtgcgaaacgcgtacatcaccatcgtcatcatattggcaggcagcaggatcattaaaaaaggcagccacggcatattgaccatcacgtcggttttcggcgtggcgagcagcgtggggtcattggccagcatgagcgagaccacgataacggtagctaaaaaaattaaaaacgcctccattcgcggcaggcgcaccgcactccacatcaacaggacgataacgcacgtaaacggccacggaatatagcgcatagcgagccagcttagcgccagcgtaatgaccagcgtcaatagcgtttccagcaacagatgcgggtcgcgatgacgcaacagatagtgtggtttaaacagtaaacctaacggcaccagcgtcagcgcgccgatggcttccgataatacccaaatcagaaacgctttcgaggcgaccgcttccggcgctatcagccaaaataacaggccgccgagtagcggcggaatcacggcgctgccgatagccagacgaaaccagtcattcaaattttgtaaggggttgtagctggggagcagttttcgtagcagtatcgcgccagtggccgcctcgataatatttattgccgtccagctaaagttaagcgaggcggcaggaaataaagtcagtgaggcgccgatgctgccgagcgagcaggcgaccgcgatcccaggccacagacggcccgcatggcggtaaaacgcgaccatcataatggaggtggggaaccacagcggcgcgagttgggtgccgacacgcgataatacgagcgaaaagagcgtaaagacaaacgcgaccaggcctaaactgaccagacgcaatagcgggtgggggacggtaacgaaaacatgttgggatggtttactcattaccactctatccgaatcgccggtaacgtcgcggaataccggacgcgtcagtttactctgtgattatgctagtataaacgcgtaatgatttatacgctgactgaatataaattgtggctcccggcgtattcctcctccagacgggtcgataaatccgctgtccgcattaaaactgaacgcttttacgtcgcgacgtcgaatgcgccgccaacaaattcaccgtggcatagcgccggactggtatcgcgctgctgaaatccctataattgccgcgtttggcgtttcggcgccccccttctttacatccaggttaatcaggtcgctaaatttatgactgatcagtctcatcagtgcgtcattatcggtatcgctggcgcatcggcttccggcaagagtcttattgccagtaccctttaccgcgaattgcgtgaacaagtgggtgacgaacatattggcgttattcccgaagacagttattacaaagatcaaagccatctgtcgatggaagaacgcgtaaaaactaactatgaccatccgaatgcgatggatcacagcctgctatttcagcatcttcaggcgctcaagcgcggttcggcgattgaattaccggtatacagttatgttgagcatacccgtatgcaggaaacggttcgcgtagaaccgaagaaagtgattattcttgaaggtattctgttactgaccgacgcgcgtttgcgtgaagagatgaacttctctatttttgtcgatacgccgctggatatctgtttgatgcgccgtatcaaacgcgatgtgaacgagcgtggtcgctcaatggattcggtgatggcgcaatatcagaaaacggtgcgtccgatgttcctgcaatttattgagccttccaaacaatatgcggatattatcgtgccgcgcggcggtaaaaaccgcatcgctattgatattctgaaagcgaaaatcagccagttctttgaataaatctggcgaattgtgtaccgttcagtgataacctggttagcccttgatgtgcttgatttaagggcttgatgcgcgaaaggagaaagtgccatgcgtttatgcgaccgagatattgaagcctggctggatgaaggccgtttgtctatcaccccgcgacctcccgtagagcgcattaacggcgcgacggtcgatgtacgtcttggcaataaatttcgaaccttccgtggccatacggcggcgtttatcgatctgagcgggccgaaagatgaggtcagcgcggcgttggatcgcgtgatgagcgatgaaatcgttttgccggacggcgaggcattttatctgcatccaggcgaattggcgctggccgtcacctttgaatccgttaccctgccaccggatttagtgggctggctggatggtcgttcctcgctggcgcgtctgggactgatggtgcatgtgacggcgcaccgtatcgatcccggctggtcgggctgcattgtgcttgagttttacaactccgggaagctgccgctggcgttgcgtccgggtatgctcatcggcgcgctgagctttgagccgctgtccggcccggcggcgcggccttataaccgccgtcaggatgccaaatatcgcgatcagcagggcgctgttgccagccggattgataaagactgagccattcggcgcaatactgccggtccattgagggtagcatgagacgatttctgacgacgctgatgattctcttggtcgtgctggtggccggattctctgcgttggtattgttggtcaatccgaatgatttccgcgcctatatggtgcagcaggttgccgcgcgtagtgaatatcagttgcaactggacgggccgctgcgctggcacgtatggccgcaactcagtatcctttccgggcgaatgacgctaacggcgcgaggcgccagcgaaccgctggtgcgggctgacaatatgcgcctggatgtcgctttatggccgctgttgagtcatcagcttcatgttaagcaggtgatgctgaaaggcggggtgattcaactgacgccgcaaacggaagcggtacgcagtgatgatgcgccggtcgcgccgaaagataataccttgccggacgtagcggaagatcgcggctggtcgtttgatattcgtagcctgcgcgttgccggcagcgtgctggttttccagcatgaaaatgatgatcaggtcacggtgcgcgatattcgtctgaatatggaacaagatgccgagcatcgcggcacgtttgatttttcgggacgcgtgaaccgcgatcagcgggatcttgctttatcgttcagcggaacggtggatgcttccgattatccgcataatttaaccgcgggtattgagcaactgcgctggcaattgcagggcgcggatctaccggcgcaggggattgaggggcagggacaattgcaggcgcagtggcaggaggcgcaaaaacgtctttcatttaaccacttaaatttaacggcgaatgacagttctctgaccgggcatgttcaggtaacgctggcggagcagccggaatggcaaattgacctccggtccagcaagcttaatctggacaacctgttgccgcatcatagcgccgtggctcagacaggcggcgcggtgtcgcaggggcaaaatacgctccccctgaccaggccagttatcgcgtcgcgtgttggtgcgccgccttatcaggggctgcaaagctttacggcggagattgctttacaggcggattcagttcgctggcggggaatggactttacccaggtttcgacgaagatgtctaatcagaccggattgctggatattactgagttgcaggggaaactggccgacggagagatgtcgctgcccggcacgctggacgcccgcaccgccagtccgcgcatcgaattccaccctcgcctcaaccatgttgagattgggactatcctgaaagccttcaattatccgattagcctgaccggtaagatgtcgctggttggcgatttctccggggcggatattgacgcagaggcatttcgccatagttggaaaggaaaagcgcatgttgacatgagcaatacgcgccttgaaggaatgaatttccagcaactggtgcagcaggccgtagagcgaagcggcggcgacgcgcagcagtcgcaggaaaatatggacaacgcgacccgactggatcgcttcacgaccgatctgacgctaaataagggcacgctgacgctcgacgacatggtcgggcaatcttctatgctggcgttaaccggcagcggaacgctggatctggttaagcagagctgtgatacacaatttaatctgcgtgtgctgggcggctggaacggcgatagcaacctgatcaccttcctgaaagagacgccggtgccgttgcgcgtctatggcaagtggcaggagctgaactataccctgcaagtggagcagttattgcgtaagcatttacaggatgaggcgaagcgtcggctcaatgactgggcggatcgcaataaagatacccgcaacggtaaagatgtgaagaagctgctgaataagctgtagtttttggccaaagggcagagccggatggcgaggctaacgcgcctccggcctgcctggtaagcaggccggggcaggcgaacagacgttacatctcctggtctggctcgccgttatgcagcggaattaactgcactttctgcactcgatggctttctacctgcaatgttttcagcaaataatcgcccacctgaacctcttcaccggtttgcggtatgcgttgcaaatattccatcaataatccggcaatcgtatggtattcccgtttttcatccagcggtagcggcacgtactgcaccaaatcctccagcggcatatggccgtttgctgtccaggaactgtccgggttcttctgaatatcgtggcgggcgtcaatttcctcgacttcattcggcagattaccggcgatagtctccatgacatcgcttaatgtcacaatgccttcaaccgagccaaactcatctacgacaaaggcaaaatgggttctggcgttacggaactgctccagcgcaggcagcagcggcaatgtttccgggaaaaccagcggttggcgaatcagcgcccgcaggttgagcggttcgccgcgcagcgattgttgcaacagatcgatgacgtggacgacgccgagtaaatcttcctgttcattttcacccgtcacgaccagacgcgtatgctggttcttttccagcagagcgcggatttccgcttccggcgcgttgagatcgatatgctcgatatcgtgacgcgacgtcatgatgctacttacggtgcgctggttgagattcagcacccgctcaatcatcctgcgctcctgcggattaaaaatctggctgtcgtcatggtctgccagcatcgcggcggtttccgcatccagttcggcatcctcttttttaccgctaatcagccgcatcacggcctccgttgtgcgctggcgcagcgtatggttagcggaaagaaaacggcggcggttaaaaatagccagttggttgagcgcctcgatcatcaccgagaagccgatagccgcgtacagataccctttcggaatgtggaaaccaaacccttccgccaccaggctaaagccgatcattagcaggaagctaaggcacaaaatgacaatggtgggatggttgttcacaaatcgggtcagggacttgctggcgagcagcatcaggctaatggcgattatcacggccgccatcatgaccgctaggtgatcgaccatccccacggcggtaatcacggagtcgagagaaaagatagcgtccagcaccactatttgcgcgaccaccgcccagaatttcgcccccttacgctgggtagggttggcgctatctttcccttccagccgttcgttgagctccatggtggctttaaagagcaggaagaagccgccgaacagcataatcagatcgcgggcgctaaagcttaacgcctgtacgctaaagagcggcttagtcaaggtgaccagccacgagattgacgccagcagcagcaggcgcatgatcatcgccagtatcaggccggtaatgcgcgcgcggtcgcgctgccccggcggtagtttttcagcgaggatggcaataaagaccaggttatcaatgccgagaacaagttcgataacgattaacgttaccagtccggcccagattgacggatcggcaatccattccatagtaagagcaataccttctgtaatatgacaattgtcacaattcgatcatggataatacggcggaaaaatgcaatgccgcagagcaatttatctttgttacggggctataaaataactttaaaatagccgtaatgtttctgtcggaaactaaataatgtcaagaatatatttaggaaatatcgcaggtggagtggagtaaataaatattgtcaacatcaataaaatcctaaaatcatctgttaattcatttaatattaatcttaaaaatatagaatggcgggtttgttaccttgcttgtcattaggttagctgcaacaattcttgcaggattaagatagcgcgcttaaatatcctgtcacgacatcgagaaaactattaatacgtaacctttatttcgctgaagatttttatctgaacgaggatgaaattggaggggaatgcgaaaatttagaataatcagtgtattggtagctaagaagctaggggcggtagcgtgcctgaaagcctgaatataagactttattattctgtcaatagcctgcggatgaattgatttttttcagaatgatgccagttaattttctctgccattaactgcaaggtaaatgtgcacggacgaagccgctatttaaattgcacaggataatgactctgccaaagtgataaataatcaatgatgaaatccaaaatgaaattgatgccattattggcgtcgctcagcttgataagtggttgcacagtactcccgggcagcaatatgtctacgatggggaaagatgtgatcaaacagcaagacgctgactttgatctcgaccggatggtcaatgtgtatccgctgacgccacggctggttgagcaattacgcccgcggcccaatgtcgcgcaaccgaatatgtcgctggaccaggagatcgccagctatcagtatcgcgtcgggcctggcgatgtgctgaatgtcaccgtctgggatcacccggaattgaccacgccagcaggccagtaccgtagctcaagcgataccggcaactgggctcagccggacggcaccatgttttatccctatattggcaaggttagcgtcgtcggtaaaactttgtcagagattcgcagcgatattaccgggcgtttagcgaagtacatcgcagacccgcaggtggatgtcaatatcgccgctttccgctcgcaaaaagcgtatatctccggccaggtgaataaatccggtcagcaggccattactaacgtcccgctaaccgtcctggatgcgattaacgctgcgggcggcctgaccgatatggcggactggcgcaacgtcgtgttgacgcacaacggcaaagaacagcgcatttcgctacaggcgctgatgcaaaatggcgatcttagtcagaaccgcttgctctaccctggcgacattctgtatgtgccgcgcaatgacgatctgaaagtctttgtcatgggcgaagtgaaaaaacagagcaccctcaaaatggatttcagcagcatgacgctcaccgaagcattaggcaatgcggaaggcatcgatctgaccacctccaacgccagcggcatttttgtgattcgtccgttgaaaggcgaggggggacgcggcggcaagatcgccaatatctaccagcttgatatgtctgacgccacgtcattggtgatggcgacggaattccgacttcagccttacgatgtggtgtacgtcacgaccgcgccggttgctcgctggaaccgtctgatcaatcagttgctgccgaccattagcggtgtccgttatatgacggatacggccagcgacattcattcctggtaatcgttatgtttaacaaaatcttagtggtctgtgtggggaatgtttgccgttccccgacggcggaacgtttgctaaagcgctttcatccttcgctgacggttgcgtctgccggattaggcgcgctggtcggcaaaggagccgatcctgcggcggcgagcgtggcgagcgcccacgatctgtctttggaaaatcactgcgcaaggcaaatttccgcgcgcctgtgccgggaatatgacctgattctgacgatggagaaacgccacatcgccgccctgtgcgacattgcgccggaaatgcgcagcaaggtaatgctgtttggtcactgggacagcgagcgtgaaataccagacccgtatcgcaaaagccgcgatgcgtttgaggcggtgtacacattactggaaaggtctgcccgccagtgggcgcaggcactgaatgcagagcagggaaaaccatgacagaaaaagtaaaacaatctgcggcggttacgggtagcgatgaaatcgatatcgggcgtctggtcggaacggtgattgaagcgcgttggtgggtgttggggacgacggccatatttgcgctgtgcgcggtaatttatacgttcttcgccacgcccatctatagcgccgatgcgctggtgcagattgaacaaaacgccggtaattcgctggtacaggatatcaacagcgcattagcgaataagccgccggcttccgatgcggaaattcagctcattcgatcgcgcctggtgctggggaagaccgttgacgatctggatctggatattgccgtcaccaaaaacacctttccgctgttcggcgccgggtgggagcggctgatgggacgtcacaatgaaatggtgaaagtcacgacattcacccgaccagagacgatgagcggacagatcttcaccctcaaagtgctgggcgacaaacgttatcagttggtcagcgacggcggatttagcgcgcagggcgttgtgggccagccactcaataaagacggcgtgacgatgcgggtagaggcgattgacgcccgtcctgatacggaatttacggtgagtaaattctcaacgcttggcatgattaataacctgcaaaataacctcaccgtaacggaaaccggcaaagataccggcgttctgaacctgacgttcacgggagaggatcgcgaccagatccgcgacattctcaacagtattacccgtaactatctgcaacaggatattgcgtggaaatctgaagaggcggggaagagcctggcgtttctggcaaaacaactgccggaagtccgcagccgtctggatgtggcggaaaacaagctaaacgctttccgccaggataaagactcggtggatttaccgctggaggcgaaggcggtgctcgattcgatggttaatatcgacgcccagttgaatgagttgacgtttaaagaagcggaaatttccaagctctttaccaaagcgcatccggcttaccgcaccctgctggaaaaacgtaaagggctggaagataaaaaagccaaactgaacgggcgggtgacggcgatgccgaaaacccagcaggagattgtgcgtttgacccgcgatgtggagtccggccagcaggtttatatgcaactgcttaataaacagcaggagctgaaaatcaccgaagccagcaccgttggcaacgtgcgcatcgttgacccggcgattacccagccgggcgtgctaaagccgaaaaaggcgttgattattctcggcagcattattctgggattaatgttatcgattgtcggcgtgctgctgcgctcgctgtttaatcgcggtatcgaaagcccgcaggcgctggaggagcacgggatcagcgtctatgccagtattccgctgtcggaatggcaaaaagcgcgcgatagcgtcaaaaccattaaagggattaagcgttacaagcagagccaactgctggcggtgggcaatccgaccgatctggcgattgaggcgattcgcagcctgcgcaccagcctccatttcgccatgatgcaggcgcaaaataatgtactcatgctcacaggcgtcagctcctctatcggtaaaacctttgtttgcgccaacctggcggccgtcatcagccagacgcataaacgggtattactgatcgactgcgatatgcgcaagggctacacccatgaactgctcggcaccaataacgtggacggcttatctgacattctggcgggcaaaggcgagatagcctcctgcgcgaaacccacggcgatcgctaattttgatcttattccgcgcggtcaggtaccgcctaatccatcggaattgctgatgagcgagcgcttcggcgagctgatcgcctgggcaagcagccgctacgacctggtattaatcgacacgccgccgattctggccgtgacggacgccgcgattgtgggtcgtcacgttgggacgacgctgatggtggcgcgttatgccgtcaacaccttgaaagaagtggaaaccagtctgagccgttttgaccagaatggcattcaggtcaaaggcgtcattctcaactccattttccgccgggcgacgggctaccaggattatggctattacgagtatgaataccagtcagattccaaataaaaaataaggcgtgccggatggcgcggcctgtgactgtaggccggacaagcgtagcgccatgcggcaaaactatctggggaataagcatgacaacagacaatccgctgatctcaatttatatgccaacctggaacaggcagcagttggctatccgggcgattaaatcagtactacgtcaggactaccgtcactgggagatgatcatcgtggatgattgctcctcgtcttatcagcagctacaacaatttgttgaggagctgaacgacccgcgcgttcgttatactcataacgccatgaataccggcgcctgcgcggttcgcaaccaggccattatgcaggcgcaaggacactacattaccgggattgatgatgacgatgaatggacgcccaaccgtctgagcgtgtttctggcccataaacaccagttgactacgcatgcctttttgtatgccaacgactatgtgtgcgagggcgaggtctactctcagcctgccagcctgccgctgtatccgaaatccccttattcgcgccgcttgttctacaagcgcaatattattggcaatcaggtttttacctgggcctggcgttttaaagcgtgtttgttcgataccgaactcaaggcggcgcaggattacgacatttttctgcgcatggtggtggagtatggcgaaccgtggaaagttgaagaggcgacgcaaattttacatatcaaccacggcgagatgcagattacctcttcgccgaaaaagttctccggctatttccatttttatcgtaagcacaaagataaattcgatcgcgccagcaaaaaataccagctttttacgctgtaccaaattcgcaataagcgaatgacctggcgcacgttgctgacgttgctctccgtgcgtaatagcaaacgcctggcggccgggctgcgggggcgataacgatgctggaagacttacgcgcgaatagctggagcttacgcccctgttgcatggtgctggcctaccgtatcgctcatttttgttccgtctggcgcaaaaagaatgtgctgaataatctgtgggccgcgccggtgctggtgctgtatcgcgtgatcacggaatgcctgttcgggtatgaaatccaggccgccgcgaccattggtcggcggttcactatccatcatggttacgcggtagtgatcaacaaacatgtcgtcgccggcgacgattttaccattcgccacggcgtcaccattggcaatcgcggcgcggacagcctggcttgtccggtgattggtcacggcgttgagctgggggcgaacgtcatcctgcttggcgatattactatcggtaatcacgtcacgattggcgcgggtagcgtggtgcttgacagtattccggatcatgcgctggtggtgggagaaaaagcacgggtgaaggtcagcacatgaatattctgcaatttaatgtacggctggcggaaggcggtgcggcgggagtggcgttagatcttcatctgcgggcgctgcaaaaagggctgacgtcgcattttgtttatggttatggcaaaggcggaaaaaaaagcgtcagtcaccaccgttatccgcaggtgataaaacagacgccgcgcggcacggcaatcgccaatatcgcgctatttcgtttcctgaatcgcgatctgtttggcaatctcgacaatctttaccgcacggttatccagacatccggcccgctggtgctgcattttcatgttctccacagttactggctaaacctggcggatatcgtgacgttttgcgaaaaagtcaaagcacaaaaaccggacgtcacgctggtctggacgctgcacgatcactggagcgttaccgggcgttgcgccttcaccgacggttgcgagggctggaaaagcggctgccaaaaatgtccgaccctaagcaattatccgccagtcagggtggatcgggcgcaccagcttattgacggcaaacgtcagcgctttcgtgacatgctgcggctgggctgccagtttatttcgccgagccagcatgtggccgaggtctttaacagcgtttatggcgcgggactctgccgggtgattaacaacggtatcgatctggcgaccgaggcgattctcgcgcaactatcacctgtgccgctgaatccgggcaaaccgcggatcgccattgtggcgcatgacttgcgttacgacggcaaaactgaccagcgtctggtacacgacatgatggcgctgggcgaaaaaattgaactgcataccttcggtaaattttcgccttttaccggccaaaacgtcgttaatcacggttttgaaaccgataagcgcaaattaatgagcgcgctcaatgagatggacgcgctggtctttagctcgcgggtcgataactatccgctgatcttgtgtgaagcgctctcgatcggcgtaccggtaatcgccacccacagcgaggcggcgcaggaggtgctggcgaaatccggcggccagacttttgccgctacagatgtactgcgcctggcgcagcggcgtaagccagagattgctcaggcggtattcggcgcaacgctggacgcctttcgtatgcgtagccgcgtcgcgtacagcggtcaacagatgctggaggagtatgtctcgttctatcagaatctgtagctatctgctgctgccgctgatctacctactggtcaatgtcaagattgcccaactgggggaaagctttcccattaccatcgtcacttttttaccgctgttgctgctgttatttgtggaacgcattagcgtaaaaaaattgatgatcgccttaggcatcggcgcggggcttacggcatttaacttcctgttcggccagtcgctgaatgccggtaaatatgtcacgtccacgatgctgtttgtctatattgtggtcattatcgggatggtctggagtatccgattcaaaaccatttccgcgcataaccaccgaaagattttgcgtttttttatctggtggtgggtatagtggtcgcgctcgccgcggttgagatggcgcaaattatccttaccggcggcagcagtatcatggaaggaatttcgaaatatctcatttacagtaatagctacgtactgaacttcataaaatttggcggtaagcgtaccactgcgctttattttgaaccggcatttttcgctttggcactaatctcaatttggctgagcatcaaacagtttggtatcaaaataccgaaaagcgatgctatgattctggcagggataatattatcaggatcattttcaggggtaatgacctttatcctgttttaccttctggagtgggcgttccaatatttgaataaggatgcgataaagaaaaaacttccactggcgctggtatcattaaccctgtttttggttggggtaattattgcatttccttatatcgcgacacgacttggcgatttagggacggaaggattatcttcttattatcgtattgtgggcccgttagtcatggtcggatattccttgacccatattgatggtgtagtcagatttggctcactttatgaatatgtcgcatcattcggaatctttaacggtgcggatgtcgggaaaaccatagacaatggattgtatctgctgattatttatttttcctggttcgcagtgctaatgacgctgtggtatatggggaaagttttaaaaatggcgctaaatgcgtttggcgataatcgcaattttcgggtgcagctctatctttttacgccggtgtcgctgttttttaccggttcaatatttagcccggaatatgcttttttaatcgtctgtccgttcattttgcgcaaggcgttaaaaatttcataacggggtggttgcatgtttttaagcgtcgttaccgtcgcctttcgcaattacgaaggggtggtaaaaacctggcgctcgctgcgcaatctggcgcgcgatccgggcctgtcatttgaatggatcgtagtggatggcggttcggaggacggcacgcgcgaatttctgcaaaaacgtcacggtgagtttaacctgcgttttatcagtgaaaaggatcgcggtatttatgatgccatgaacaaaggcattgccttggcgcaggggcgctataccctgtttcttaattccggtgatgcgttccatgatgatgccgcgctgtttgtccgccaactggcgcggcaaaagggcgaggcgatgtatattggcgacgcgctgctggatttcggcggcgggcataaaatacgccggaaagctaaacccgggtattatatctaccatagtttgccagccagccatcaggcgatatttttcccgacggcagcgttaaaaaagtatccttatgatctgcaatatcatgtctcttcagattatgcgctggcggcccgtctctataaagcaggctatccttttcggcgaattaacggactggtatctgaattttcgatgggcggcgtgtcaacctcgaataatctggaattatgtcaggatgcaaaaaacgtacagcgaaaaatattacgtgttccagggttttgggcgcaattatcctatttgttacgtctgaaaacgacgggtaaaacaaaagcgcggtataacaaagtctaatcaccgggagttattatgcaggatcttagcggctttacggtgccgaaagggttccgcggcgctaatgcgctaaaagtacaattatggtgggcggtacaggcgacattattcgccggatcgccgcaaatattgtatcgctggcgagcctttttgctgcgtctgtttggcgccaaaattggaaaaaatgtggttattcgaccgtcagtaaaaattacctatccgtggaaattaaccgtcggcgattatgcctggataggcgacgacgctgtgttatatacgttgggtgaaattaatattggcgcacatgcggttatttcacaaaaaggttatttatgtaccggtagccatgattataccagcgcccatttcgatattaacgccgcgccgattgttattggcgaaaaatgttggctggcgaccgatgtttttgtcgcgcccggcgtgacgataggtcatggcaccgtcgtcggcgcgcgtagcagcgtatttaaatcattaccggcaaatgcgatttgtcggggcaatcccgcagtggtaacgcgccagcgcgttcagaaagttactccctaacgggactatttgaggaaatgaaaatgtcaaaagtcgctctcattactggcgtaaccggacaggatgggtcttacctggcagaatttctgctggaaaaagggtatgaggtgcatggtatcaagcgtcgcgcgtcatcgtttaataccgagcgcgtggaccatatttatcaggacccgcacagctgcaacccgaaatttcatctgcattatggcgacctgaccgacgcctcaaacctgacccgcattttacaagaagtgcagccggatgaggtctacaacctgggcgcgatgagccacgtggcggtgtcgtttgagtcgccggaatataccgccgatgtggatgcgatgggcactctgcgcctgctggaggcgatccgcttcctcggtcttgaaaagaaaacgcgtttctaccaggcctccacctctgaactgtacgggctggtgcaggaaatcccgcagaaagagaccacgccgttctacccgcgttctccctatgcggtggcgaaactgtacgcctactggatcaccgtcaactaccgtgaatcctacggtatttacgcctgtaacggcattctgtttaaccacgagtctccgcgtcgtggcgaaaccttcgtcacccgtaagatcacccgcgccatcgccaatatcgcccagggactggagtcctgcctgtatctcggcaacatggactcgctgcgcgactggggccatgcgaaagattacgtacggatgcagtggatgatgttacagcaggagcagccggaagatttcgtgattgccaccggcgtgcagtattccgtacgccagtttgtggagctggcggcggcgcaactggggataaaactgcgctttgaaggcgaaggcattaatgagaaagggatcgtggtatccgttaccggacacgatgcgccgggcgtgaaaccgagggatgtgattgtggccgttgatccgtgttatttccgtccggcggaagtggaaaccctgctgggcgatccgtccaaagcgcatgagaaactgggctggaaaccggaaattaccctgtcggagatggtctccgagatggtggcgaacgatctggaggccgcgaaaaaacactcactgctgaaatctcacggttacgaggtggccatcgcgctggagtcctgagaatgaataagcaacgaatttttgtggcgggccatcgcgggatggtgggctccgccattgtacggcagcttgcgcagcgcggcgacgtggaactggtgctgcgcacccgcgatgagctggatctgctcgacgggcgcgcggtacaggcgttctttgccggagcgggtatcgaccaggtttatctggcggcggcgaaagtgggcggcattgttgccaacaacacgtatccggcggattttatttatgaaaacatgatgatagagagcaacattattcacgccgcgcacctgcacaacgtgaacaaactgctgtttctcggttcgtcctgtatctatccgaaactggcaaggcagccgatggcggaaagcgagctgctgcaggggacgctggagccgaccaacgagccgtatgccatcgccaagatcgccgggattaaactgtgcgagtcctacaaccggcagtacggtcgcgactaccgttcggtgatgccaaccaacctgtacggcccgcatgataatttccacccggacaattcacatgtgatcccggcgctgctgcgtcgctttcatgaggctgcgcagagccacgcgccggaggtggtggtgtggggcaacggcacgccgatgcgcgaatttctgcacgttgacgatatggcggcggccagcattcacgtgatggagctggcgcgcgaagtgtggcaggagaacaccgccccgatgctgtcgcacattaacgtcggcactggcgtggactgcaccattcgcgagctggcgcagaccatcgcaaaggtggtgggttaccagggccgggtggtgttcgacgccgcgaagccggacggcacgccgcgtaaattgctcgacgtcacgcgcctgcatcagcttggctggtatcacgaaatttcactggaggcagggcttgccggtacttaccagtggttccttgagaatcagcaacggttccgggggtgacaatgtttttacgtcaggaagatttcgccgccgtggtgcggaccacgcccctcatctccctcgatttcatcgtggaaaacggccagggggaaattttgctgggccagcgcctcaaccgtccggcgcagggctactggtttgtgccgggggggcgggtgtgcaaagacgaaacgctggaggccgcttttgcacgcctgacgcaggcggaactgggcgtgcgtctgccgctggcggcagggacgttttatggcgtctggcagcacttctatgacgacaacttttccagtgaggatttttcaactcactacatcgtgctcggctttcgtctgcgcgtggcggagagcgatttacgcctgcctgatgcccagcatggcagttaccgctggctgacgccggaacagcttctggcaggcgacaatgttcatgagaacagtcgggcctacttctctcctgacgcgccggcggtgggcctatgaagatcctggtctatggcattaactattcaccggaactgaccggtatcggcaaatataccggcgaaatggtggcgtggatggcgcgggaaggccatgaggtgcgggttattactgcgccgccgtactacccgcagtggaaggtcggtgagcgctattccgcctggcgctatcgccgggaagagggcgaggctaccgtctggcgctgcccgctgtatgtgccgaaacagccctccaccctaaaacgactgcttcatctggggagctttgcattgagcagttttttcccactgatggcgcagcgtcgctggaagccggatcggattatcggcgttgtaccgacgctcttttgtacgccgggaatgcgtctgctggcgacactctccggcgcgcgtaccgtactgcatattcaggattacgaagtggacgccatgctcggcttaggaatggcgggaaaaggcaagcgcggcagcgtagcgcggttagcgacggcctttgaacgcagcgcgctgcgtaacgttgataatgtttcgaccatctctcgctccatgatgaataaagcgcgggaaaagggcgtcgcggcggaaaaaatcctcttttttccaaactggtcggaagtggcgcgctttcaggacgttaatgacgctgacgtgacggctttgcgtcagcagcttggcttgccagagggcaaaaaaatcgtgctctattccggcaatatcggcgaaaaacaagggctggaaaaggtgattgacgccgcagaacgattacgcgatcgaccgttgatttttgcgattgtcggccaggggggcggcaaggcgcggctggagaacatggcccgcgaacgcggcctgctaaatattaaattcctcccgctgcagccttacgacgccttacccgcgctgctgaaaatgggcgactgccatctggtggtgcaaaagcgcggcgcagcggatgcggtactgccctccaagctgactaacattctggcggtcggcggtaatgcggtgattaccgctgagccgcacaccgaattaggacaactttgcgcgcgctatccgggcatcgccgtttgcgtggagccggagtcgaccgacgcgctggtcgacgggattagccaggcgctcgccatgccgaaaaacaacacgacggcacgtgaatacgccgaacgcacgctcaataaagagaacgtgctacgccaatttattgcagatattcggggatgataatgcgtcagacaaaactttacccggttgtgatggccggtggctccggtagccgattgtggccgctttctcgcgtgctttatccaaaacagtttttgtgcctgaaaggcgatctcaccatgttgcaaaccaccatttgccgtctgaacggcgtggagtgcgaaagcccggtggttatctgcaacgaacagcaccgttttatcgtcgccgaacagctccgccagctcaataagctgacggagaacattattcttgagcccgccgggcgcaataccgcgccggcgattgcgttggcggcgctggcagcgacgcgccagcatacggactgcgatccgctgatgctggtactggcggcggatcatgcgatcgccaatgaagaggccttccgcgacgcggtgcgcggcgccatgccctatgccgacgcgggcaaactggtgaccttcggtatcgtgccggatctgccggaaaccggctatggctatatccggcgcggtgatgtcgtgccgggcgcgacggatgcggtggcttttgaggtggcgcagttcgttgagaagccggggctggaaaccgcccaggcctacgtcgccagcggcgattactactggaacagcggcatgtttctattccgcgccggacgctatctggaagagctgaaaaagttccgccccgatattctggccgcctgtgaacaggcgatgcgcggcgtcgatccggatcttgacttcattcgcgtggatgaagaggccttcctcgcctgtccggaagagtccattgactacgcggtgatggagcggacggcggacgcggtggtgatgccaatggacgcgggctggagcgatgtcggctcgtggtcctcactgtgggaaatcagcgcccacaccccggagggaaacgtccaccacggcgacgtcatcagtcataaaacggaaaacagctacgtttacgccgaatccggcctggtgaccaccgtcggcgtgaaggatctggtggtggtgcagaccaaagacgccgtgctgattgccgatcgccacgcggtgcaggacgtgaaaaaggtggtggagaagatcaaggccgacggacgccatgagcaccacatgcaccgcgaggtttaccgtccgtggggcaaatacgactccatcgacgcgggcgagcgctatcaggtgaagcgcattaccgttaagccgggggaaggactgtcggtgcagatgcaccatcaccgtgccgagcactgggtggtggtggcggggaccgccagagtcaccatcaacggcgaggttaagctgctcggtgaaaacgagtccatctatattccgctgggggcgacccactgcctggaaaatccgggaaaaataccgctcgatttaattgaagtgcgttccggctcgtatctcgaagaggacgacgtggtgcggttcgaggaccgttacgggcgggtctgacgcctgcaattatgcccggtaagcgcaacgcgccatccggcaatgaataacaataacgatgttggccatttgcggtcagggctaactgttgcctgaagaagggtaagcacatgacaaaattaacctgtttcaaggcctacgacattcgcggcaggctgggcgaagagctcaatgaagatatcgcgtggcggattggccgcgcctatggcgaatatttaaaaccgaaaaccatcgtgctgggcggcgacgtgcgcctgaccagcgaggtgctgaagatggcgctggcaaaagggttacaggacgcgggcgtcgacgtgctggatatcggtatgtccggcaccgaagagatttacttcgccaccttccacctcggcgtggacggcggtattgaagtgaccgccagccataacccgatggactacaacggtatgaagctggtgcgcgagggcgcccgcccgataagcggcgacaccggtctgcgcgacgttcagcgcctggcggaagcgggcgacttcccgccggtcaacgacgccacgcgcggcagctacagacaaatcagcatgcgcgacgcctacatcgaccacctgctcggctacatcagtgttaacaatctcaccccgctgaagctggtgtttaacgccggcaacggcgcggcggggccggtcattgacgccattgaagcgcgcctgaaggcgctgggcgcgccggtggagttcatcaaaatccacaacaccccggacggcaccttcccgaaaggcattcccaacccgttgctgccggagtgtcgcgacgacacccgcaaggccgttattgaacacggggcggacatgggcatcgcctttgacggcgacttcgaccgctgcttcctgttcgatgagaaagggaagtttatcgaggggtactacatcgtcgggctgctggcggaagcgtttctggaaaaacacccgggggcgaagattatccacgacccgcgcctgacctggaacaccgaggcagtggtgacggcggcgggcgggacgccgatgatgtcaaaaaccgggcacgcctttatcaaggagcggatgcgtacggaggatgccatttatggcggggaaatgagcgcgcatcactatttccgtgattttgcctactgcgacagcgggatgatcccgtggctgctggtggcggaactggtatgcctgaaggggcagtcgctgggtgaactggttcgcgaccggatggcggcgttcccggcgagcggggaaatcaacagcagactggcggagccggcggcggccatcgcgcgggtggaagcgcacttcgcggaagaggcgcaggcagtggaccgcacggacggcctcagcatgtcgttcgccgactggcgtttcaacctgcgctcgtcgaacaccgaaccggtggtgcgcctgaatgtggaatcacgcggcgatattccgctgatggaagcgcgaacacgcactctgctggcgctgctgaatcagtaacgtcagatctccccttaccgcctgcgggtaaggggccaatcacaggaacaacgatgacaaatctaaaaaagcgcgaacgagccaaaaccaatgcatcgttaatctctatggtgcaacgcttttcagatatcaccatcatgtttggcgggctgtggttcatctgtgaagtcagtggactgccattcctgtacatgcacctgttggtggcgctgattacgctggttgtttttcaaatgctgggcgggatgaccgatttttatcgctcctggcgcggcgtcaaaatgtcgacagagttaacgctgttactgcaaaactggacgctgagcctgatcttcagcgccggtctggtggcgtttaatgatgactttgacaaccgcctcgccacctggttggcctggtatgcgctgtccagcctgggcttagtgttatgccgttcatttattcgtttcggcgcgggctggctacgcaatcgtggttataacactcgccggggcgccgtcgccggggatttgcctgcgggccaggcgttgctggatagcttccgtaatgagccgtggctgggttttgaggtggtgggcgtctatcacgatcctaaaccgggcggcgtctctgctgactgggccgggaacttcgaacagttaattgacgatgcgaaagcctcgcgaattcacaatgtttatatcgccatgtcaatgagcgacggcgccatggtgaaaaaactggtgcgcgagctggccgacaccacctgctcggtgatccttattcccgatgtgttcacctttaatattctccactcgcgcgtggaggagatgagcggcgttccggtcgttccgctgtatgacacgccgctatcagggattaaccgtctgcttaaacgggcagaagatatcgtgctggcgtcgctgattctgctgctcatctcaccggtactgtgctgcattgcgccggcggtcaaattgagctcgcccgggccggtgattttccgtcagacgcgctacgggatggacggcaagccgagcaaagtctggaggttccgctcaatgaaggtgatggagaacgataaggtcgttacccaggcgacgcaaaacgatccgcgcgtcacccgggtaggtaactttttgcgtcgtacctcgctggatgaattaccgcagtttatcaacgtattaaccggcgggatgtctatcgtcggtcctcgcccgcacgcggtggcgcataacgaacagtatcgtcagttgattgaaggttacatgctacgccacaagatgaagccgggcatcaccggctgggcgcaaattaatggctggcgcggtgagaccgatacgctggagaaaatggaaaaacgcgtggaattcgacctggaatacatccgcgaatggagtatttggttcgatatcaaaatcgtttttctgacgatttttaaagggtttgttaataaagcggcgtattaagaacctgacccacaaggctattttacttgccatattgcaccagggcagtgctcaatctggctgcgccaatgacgccttgtgaacaggttctggagaaaagaatgagtttacgacaaaaaacgatcagcggcgttaaatggtcggctatcgccacgatagtgattatcggtctggggttaattcagatgacggtgctggcgcggatcatcgacaaccaccagtttggcctgttgaccgtatcgctggtgattatcgcgctggccgacacgatttcggactttggcatcgcgaactcgattatccagcgtaaaacgattgggcatctggagctgaccacgctttactggctaaacgttgggcttgggattgtggtatttgcggtggtcttttggctgagcgatgcgattgcccatgttttgcataacccggatctcgcgccgttaatcaaaacgttgtcgctggcgttcatcgtgatccctcacgggcagcagttccgcgcgctgatgcaaaaagagctggagttcaataagatcggcatgatcgaaacgacctccgtgctggcggggttcacctttacggtgattagcgcccattactggccgctggcgttaaccgcgattctcggctatctggtgaacagcgcggtgcgaacgctgctgtttggttactttggccgcaagatttaccgtccggggctgcatttttcgctggcatcggtgtccacgaacctgcgttttggcgcgtggctgacggcggacagtatcgtcaattacatcaacacgaatttatcgacgctggtactggcgagaattctcggcgcaagcgtcgccgggggatataacctcgcgtacaacgtggctgttgtgccgccggcgaagcttaaccccatcattactcgcgtgctatttccggcattcgccaaaatccaggacgataccgagaagctgcgcgtcaacttctataagttgctttccgtggtgggaattatcaattttcccgcgctgttgggcctgatggtagtggcgaacaattttgtgccgttagtgtttggtgagaagtggaacagcattatcccgatcctgaaattgctgtgcgttgtggggctgctgcgctcagtcggcaacccgattggttcgctgctgatggcgaaagcgcgcgtggatatcagctttaagttcaacgtctttaaaacgtttctgtttatcccggcaattctcattggcggccatctggcgggggcgattggcgtgacgctggggttcctggtggtgcaaatcatcaacaccattctgagctatttcgtgatgattaagccggtactcggctccagctaccgtcagtatattctcagcctgtggctaccgttttatctctcattgcccacatttattaccagctacggcgcaggaaagctagtcgacggctatttaccgttgtcaggggtattcgcgctacaggttgtggtcggtattttgagttttattttaatgattattttttcacgcaatgcgctggtgatggaaattaaaaatcagcttgttggcagtgaaaaaatgaaaaagttattacgtgtcggatgacgaggatataagaggctatttatgaaattattaattttaggcaaccacacatgcggcaaccgtggtgatagcgccattatgcgcggtttgcttgatgccatccgtcaacaggcgccagaggcggagatggatgtgatgagccgtttcccggtgagttcctcctggttgcaggggcgaccgattattgccgacccgctgtatcaattaagccagaaacagcaggcggcggcagggcttaacggtcgggtgaaaaagtattacgccgtcgttttcagcataaaattttattgtctaaagtcgcccaggaaggatcgctgcgtaattttgctatcgcgccggaatttgccgaattcgcgcaatttattgcgcagtatgacgccgtcattcaggtgggcggttcaaactatgtcgacttatacggtttgactcactttgaatatccgctgtgcgcgtttatggcgaacaaaccaatttatatggtgggacatagcgtcggccctttccagaaccctgactttaactagctcgccaattatgttttgggcgcaccagtgcgctgatcctgcgtgaaaccgtcagccgcgatctgatgaccgccgcgcagatcgatacccgaaaagtagagcagggggtggataccgcctggttagtcgaacgccgtcacgacgagtttgtcgccagttatgctgtgcagcactggctggacgtcaccgcgcgccgcaaaaccgtcgcgattacgttgcgcgatctggagccgtttgataaacgcctgggcaccactcagcaggcctatgagcaggcatttgcccaggtcgtgaatcgcctgattgcggacggttatcaggtactggcgctgtcgacctgcaccagtatcgatcgctataaccgcgatgaccggatggttgcgttacggatggcgaagtatgtaaacgactcagagcatttccatatcgcgatggacgaactcaatgacgtggaaatcggaaagatcctcgcatcctgcgtactgaccatcgggacgcgcctgcattccgccattatctccatgaattttggcacgcccgctatcgccattaattatgaacataaatccgccgggattatgcagcagctaggcctggcggaattggccatcgatatccgtcacttgctgaacggttcattacaaagcgtggtggccgatacgctcaatcaattgcctgcgctaaaggcaaaagtggctaacgccgtcaccgaggagcgggcgaaagggttcacgatgatcaaatctgctctcgacagaattcgggaggcgcaatgaaagtcagcttttttctgctgaaatttccactctcatcggaaacctttgtgctgaatcagattactgcgtttattgatatgggccatgaggtggagattgtcgcgttacaaaaaggcgatacccaacatactcacgccgcctgggagaagtatggcctggcggcgaaaacccgctggttacaggatgagccccagggacggctggcgaagctgcgctaccgggcatgtaaaacgctgccggggctgcatcgggcggcgacctggaaagcgctcaattttacccgctacggcgatgaatcacgcaatttgatcctttccgcgatttgcgcgcaggcgggccaaccttttgtggcggatgtgttcatcgcgcactttggtccggcgggcgtgacggcggccaaactgcgcgaactgggcgtgcttcgcggcaaaatcgagactattttccacggaattgatatttccagtcgcgaggtgctcagtcattacacgccggagtatcagcagttgtttcgtcgtggcgatctgatgctgcccatcagcgatctgtgggccggtcgcctgaaaagtatgggctgtccgccggaaaagattgccgtttcgcgcatgggcgtcgacatgacgcgtttttcccatcgtccggtgaaagcgccagggatgccgctggagatgatttccgtcgcgcgcctgaccgagaaaaaaggcctgcatgtggcgattgaagcctgtcggcaactgaaagcgcagggcgtggcgtttcgctaccgcattctggggattggcccgtgggaacgtcggctgcgcacgctcattgagcagtatcagttagaggatgtcattgagatgccgggttttaaaccgagccatgaagtgaaggcgatgctggatgacgccgatgtttttttgctgccgtcgattaccggtacggatggcgatatggaaggtattccggtagcgctgatggagacgatggcggtggggattcccgtggtgtctaccgtgcatagcggtattccggaactggtggaggccggcaaatccggctggctggtaccggaaaacgatgcgcaggcgctggcggcccgactcgctgagttcagccggattgaccacgatacgctggggtcggtgatcatgcgcgctcgtgaaaaagtggcgcaagattttaatcagcaggcgattaatcgccagttagccagcctgctacaaaccatataaacgaggtggtatgcccgcgactaaattctcccgacgtaccctcctgacggcaggttccgcgcttgctgttcttccttttctgcgcgccttgccggtacaggcgcgtgaacctcgccagaccgtcgatattaaggattatccggcggatgacggtatcgcctcgttcaaacaggccttcgccgacgggcagactgtggtcgtgccgtcaggatgggtgtgtgaaaatatcaatgcggcgataacgattccggcgggaaaaacgctgcggatacagggcgcggtgcgtgggaatggccggggacggtttattttgctggacgggtgtcaggtggtgggggagcagggcggcagtctgcacaatgtgacgctggatgttcgcgggtcggactgtgtgattaaaggcgtgacgatgagcggctttggccccgtcgcgcaaattttcatcggcggtaaggaaccgcaggtgatgcgtaatctcattatcgatgacatcaccgttacccacgccaactacgccattctccgccagggatttcataaccaaatggacggcgcgcggattacgcatagtcgctttagcgatttgcagggggacgccattgagtggaatgtcgcgattcatgaccgcgacatcctgatttccgatcatgtcatcgaacgcattgattgtaccaatggcaaaatcaactgggggatcggcatcgggctggcgggtagcgcctatgacaatagttatcctgaagaccaggcagtaaaaaactttgtggtggccaatattaccggatctgattgccgacaactggtacacgtagaaaatggcaaacatttcgtcattcgcaatgtcaaagccaaaaacatcacgcccgatttcagtaaaaatgcgggtattgataacgcaacgatcgccatttatggctgtgataatttcgtcattgataatattgatatgacgaatagtgccgggatgctcatcggctatggcgtcgttaaaggaaaatacctgtcaattccgcaaaactttaaattaaacgctattcggttggataatcgccaggttgcttataaattacgcggcattcaaatttcctccggtaacgccccctcatttgttgccatcaccaatgtacggatgacgcgtgctacgctggaactgcataatcaaccgcagcacctctttttgcgtaatatcaacgtgatgcaaacttcagcgattggcccggcgttaaaaatgcattttgatttgcgtaaagatgtccgtggtcaatttatggcccgccaggacacgctgctttccctcgctaatgttcatgccatcaatgaaaacgggcagagttccgtggatatcgacaggattaatcaccaaaccgtgaatgtcgaagcagtgaatttttcgctgccgaagcggggagggtaagtaccgctatttttacgaaaattcctgggaaaaagttgttcatacttaatgttatggtgccgactaagacgtaatgtagagcgtgccatcattatccctggcagcagagtaattcatgctggcgaaaacaagctaaagagctataattcagcaaccattttacaggtggaagaaacaatgatgaatttgaaagcagttataccggtagcgggtttgggtatgcatatgttgcctgccaccaaggcaatcccaaaagagatgctaccgatcgtcgacaaaccgatgattcagtacattgtcgatgagattgtggctgcagggatcaaagaaatcgtgctggtgactcacgcgtctaaaaatgccgttgagaaccacttcgacacctcttatgaacttgaatcgcttcttgagcagcgcgttaagcgtcagcttctggcggaagtgcaatctatctgcccaccgggcgtgacgattatgaacgttcgccaggcgcagccgttaggactggggcactctattctgtgcgcgcgtccggttgtgggcgataaccctttcattgtggtactcccggatattattattgatgatgctaccgccgatccgctgcgctataaccttgcggcgatggtggcgcgtttcaatgaaacgggtcgcagccaggtgctggcaaagcgcatgaaaggtgatttatcggagtattccgttatccagacgaaagaacctctggataatgaaggcaaagtcagccggattgtggagtttatcgaaaaaccggatcagccgcagacgctggattccgatttgatggcggtaggccgttatgtgctttcagccgacatctgggcggaactggaaagaaccgaaccgggcgcctggggccgcatccagcttaccgatgcgattgctgaactggcgaaaaaacagtcggttgacgcgatgctaatgacgggcgacagctatgactgcggtaaaaaaatgggctacatgcaggcatttgtgaagtacgggctgcgcaacctgaaagaaggagcgaagttccgtaagagcatagagcagcttctgcatgaataagtattaacaaccgtgataaatggttggtgataaacataataacggcagtgaacattcgaagcggcaagttggctgaaacgagtgttgactgccgttttagttttgtataaagggcttaagtaacaaggggttatctggagcattttaatgctgattttataagattaatccttgtttccggatgcaattaataagacaattagcgtttaagttttagtgagctttgccctgctgggcgaggtttgtaacaagtcgatatgtacgcagtgcactggtagctgatgaaccaggggcggtagcgtgtgtaacgacttgagcaattaatttttattggcaaattaaataccacattaaatacgccttatggaatagaaaagtgaagatacttattactggcggggcaggttttattggatcagctgttgttcgccatattattaagaatacacaggacactgtagttaatattgataaattaacctacgccggtaatcttgaatccctttctgatatttctgaaagtaatcgctacaattttgaacacgcggatatttgtgattccgctgaaataacgcgtatttttgagcagtaccagccggacgcggtgatgcatttggctgcggaaagtcatgtggaccgttcgattaccgggccggcagcatttattgaaaccaatatcgtcggcacctatgtacttcttgaagttgcgcgtaaatactggtctgcgcttggcgaagataaaaaaaataattttcgttttcatcatatttccactgatgaagtttacggcgatttaccacatcctgatgaagttgaaaacagcgttacgttgccgttatttactgaaacgacggcatatgcgccaagtagcccctattctgcgtcaaaagcatccagcgatcatttagtccgtgcctggcggcgtacctatggtctaccaacgatcgttaccaattgttctaataactatggcccttatcacttccctgaaaaactgattccgttggtcattttgaacgcactggaaggaaagcctttgccaatttatggcaaaggggatcagattcgcgattggctatatgtagaagatcacgctcgcgcgcttcatatggtagtgactgaaggcaaggcaggggagacttataacattggtggccacaatgagaagaaaaatctcgatgtggtatttaccatctgtgatctgctggatgagattgtacccaaagcgacttcttatcgtgaacaaatcacttatgtcgcggatcgtccgggccatgatcgtcgttatgccattgatgcaggtaaaattagccgtgaattaggctggaaaccgctggagacctttgaaagcggtattcgtaaaacagtggaatggtaccttgcaaatactcaatgggtaaacaatgttaaaagtggggcgtatcagagttggatagaacagaactatgaaggacgccagtaatgaatatcttactttttggtaagacagggcaagtaggctgggagttgcaacgttctctggcgccagtggggaatctgattgccctggatgtccattcaaaagagttttgcggtgattttagtaatccgaaaggcgttgccgaaaccgttcgtaagcttcgtcccgatgtgattgttaacgcagcagcacatactgcagtagataaagcagagtctgaaccagaactggcgcagttgcttaacgccaccagtgtggaagccatcgctaaagcggccaacgaaattggcgcatgggtagtgcattattcaaccgattatgtatttcctggtaccggcgatatcccatggcaggaaacggacgctacgtcgccgctgaatgtctatggcaagaccaaactagcgggagaaaaggccctgcaggataactgccctaaatacctaatcttccgcaccagttgggtttatgcaggtaagggcaataatttcgcaaagacaatgcttcgtctggcgaaagagcgtcagacactttcagtcatcaacgatcagtacggtgcgccaaccggtgcggaattactggctgactgcacggctcatgcgatccgtgtgacattaaataaaccagaagtcgcaggtctttaccatctggttgccgggggaactacaacctggcatgactacgcggcgttagtctttgacgaggcgcgcaaagcagggataacgcttgcgctgactgagcttaatgctgtgccgaccagcgcctacccgacgccggcgagcagacctggtaattcgcgtctcaatactgaaaagtttcagcgtaattttggccttattctgccgcaatgggaattaggagttaagcgtatgctgactgaaatgtttacgacgacaaccatctgataaatttaaatgcccataagggcattttctatgaatgagaaatggaaatgaaaacgcgtaagggcattattttagcgggaggctccggcactcgtctttatccggtgaccatggcggtaagtaagcaattgctaccaatttatgataaaccgatgatttactatcccctttccacacttatgctggcaggcattcgggatatcctgatcatcagtacgccacaggacacgccgcgttttcaacaactgctgggagacggcagccaatgggggctgaatcttcaatataaagtacagccaagtccggatggcttagcacaggcgtttattattggtgaagagttcattggtaataatgattgtgcattagtgctgggtgacaatatcttctatggtcatgatttaccaaagttaatggaagctgccgttaataaagaaagtggtgctaccgtcttcgcttatcatgtaaacgatccagagcgctacggtgtggttgagtttgaccaaaatggcacagccgttagtctggaggaaaaaccgttacaaccgaagagtaattacgcggtaacggggctgtatttttatgataatagcgtggtggagatggcgaaaaatcttaagccttcctctcgcggtgagttagaaatcacggatattaaccgtatctatatggatcagggaagattgtctgtcgctatgatggggcgcggttatgcctggctggatacgggaacgcatcagagtttgatagaggccagtaattttattgcaaccatcgaagaacgccagggtctgaaagtgtcttgcccggaagagatcgcatttcgtaaaaattttataaatgcacaacaggttataaaactggccgggccattatcaaaaaatgattacggcaaatatttgctgaagatggtgaaaggtttataagtgatgattgtgattaaaacagcaataccagatgtcttgatcttagagcctaaagtttttggcgatgagaggggattcttttttgaaagttataaccagcagacctttgaagagtcgattggacgtaaagttacatttgttcaagataatcattcaaaatccaaaaagaatgtactcagagggctacattttcagagaggagaaaatgcacagggaaagttagttcgctgtgctgtcggtgaggtttttgatgttgcggtcgatatccgaaaagaatcacctacttttggtcagtgggttggcgtaaatctatctgctgagaataagcgacagctttggattccagaaggttttgctcatggttttgttactctcagtgattatgcagagtttctgtacaaagcaactaattattactcaccttcatcggaaggtagcattctatggaatgatgagacaataggtattgaatggcctttttctcagctgcctgagctttcagcaaaagatgctgcagcacctttactgcatcaagccttgttaacagagtaagcatcgtgtctcatattattaagatttttccatcaaatattgaattttccggtagagaggatgaatcaatcctcgatgctgcgctatcggctggcatccatcttgaacatagctgcaaagcgggtgattgtggtatctgtgagtccgatttgttagcgggagaagttgttgactccaaaggtaatatttttggacagggtgataaaatactaacctgctgctgtaaacctaaaaccgcccttgagctaaatgcgcatttttttcctgaactagctggacagacaaaaaaaattgtcccatgcaaggtaaatagtgctgtactggtttcaggcgatgttatgactttgaagttacgcacaccaccaacagcaaaaattggcttctttccagggcagtatatcaatttacattataaaggtgtaactcgcagttattctatcgctaatagtgatgagtcgaatggtattgagttgcatgtaaggaatgttcccaatggtcagatgagctcgctcatttttggggagttacaagaaaatactcttatgcgcattgaaggaccttgcggaacattttttattcgtgaaagtgacagacctataatcttccttgcaggcggtactggattcgctccagttaaatcaatggttgagcatctcattcagggaaaatgtcgtcgtgagatctacatctactggggaatgcaagatagtaaagatttttactctgcattaccgcagcagtggagtgaacagcacgacaacgttcattatatccctgttgtttctggtgatgacgccgaatgggggggaagaaagggatttgtccatcatgctgtgatggatgattttgattctctagagttcttcgatatatatgcatgtggttcacctgtgatgatcgatgccagtaaaaaggactttatgatgaaaaatctctctgtagaacatttctattctgatgcatttaccgcatctaaataatattgaggataatttatgaaagcggtcatcctggctggtggacttggtaccagattaagtgaagaaacaattgtaaaaccaaaaccgatggtagaaattggtggcaagcctattctttggcacattatgaaaatgtattctgtgcatggtatcaaggattttattatctgctgtggttataaaggatatgtgattaaagaatattttgcgaactacttccttcacatgtcagatgtaacattccatatggctgaaaaccgtatggaagttcaccataaacgtgttgaaccatggaatgtcacattggttgatacgggtgattcttcaatgactggtggtcgtctgaaacgtgttgctgaatacgtaaaagatgacgaggctttcctgtttacttatggtgatggcgttgccgaccttgatatcaaagcgactatcgatttccataaggctcacggtaagaaagcgaccttaacagctacttttccaccaggacgctttggcgcattagatatccaagctggtcaggtccggtcattccaggaaaagccgaaaggcgatggggcaatgatcaatggtggtttctttgtgttgaatccatcggttatcgatctcatcgataacgatgcaacaacctgggaacaagagccattaatgacattggcacaacagggggagttaatggcttttgaacacccaggtttctggcagccgatggataccctacgtgataaagtttacctcgaagggctgtgggaaaaaggtaaagctccgtggaaaacctgggagtaagtagatgattgataaaaatttttggcaaggtaaacgtgtattcgttaccggccatactggctttaaaggaagctggctttcgctatggctgactgaaatgggtgcaattgtaaaaggctatgcacttgatgcgccaactgttccaagtttatttgagatagtgcgtcttaatgatcttatggaatctcatattggcgacattcgtgattttgaaaagctgcgcagttctattgcagaatttaagccagaaattgttttccatatggcagcccagcctttagtgcgcctatcttatgaacagccaatcgaaacatactcaacaaatgttatgggtactgtccatctgcttgaagcagttaagcaagtaggtaacataaaggcagtcgtaaatatcaccagtgataagtgctacgacaatcgtgagtgggtgtggggctatcgtgagaacgaacccatgggagggtacgatccatactctaatagtaaaggttgtgcagaattagtcgcgtctgcattccggaactcattcttcaatcctgcaaattatgagcaacatggcgttggtttggcgtctgtgagggctggtaatgtcataggtggaggcgattgggctaaagaccgtttaattcccgatattctgcgctcatttgaaaataaccagcaggttattattcgaaacccatattctatccgtccctggcagcatgtactggagcctctttctggttacattgtggtggcgcaacgcttgtatacagaaggtgctaagttttctgaaggatggaatttcggcccgcgtgatgaagatgcgaagacggtcgaatttattgttgacaagatggttacgctttggggtgatgatgcaagctggttactggatggtgagaatcatcctcatgaggcacattacctgaaactggattgctctaaagcaaatatgcaattaggatggcatccgcgttggggattgactgaaacacttagtcgcatcgtaaaatggcataaagcatggattcgcggcgaagatatgttgatttgttcaaagcgtgaaatcagcgactatatgtctgcaactactcgttaagaaaataagtttaaggaatcaaagtaatgacagcaaataacctgcgtgagcaaatctctcagcttgtcgctcagtatgcgaatgaggcattgagcccgaaaccttttgttgcaggtgcaagcgttgtacctccttccgggaaggttattggtgccaaagagttacaattgatggttgaggcgtctcttgatggatggctaactactggtcgtttcaatgatgcctttgagaaaaaacttggggaatttattggagttcctcatgttttaacgactacatctggctcttcggcaaacttgctggcactgactgcgctgacttccccaaaattaggcgagcgtgctctcaaacctggtgatgaggttattactgtcgctgctggcttcccgactacagttaacccggcgatccagaatggtttaataccggtattcgtggatgttgatatcccgacatataatatcgatgcctctctcattgaagctgcagttactgagaaatcaaaagcgataatgatcgctcatacactcggtaatgcatttaacctgagtgaagttcgtcggattgccgataaatataacttatggttgattgaagactgctgtgatgcccttgggacgacttatgaaggccggatggtaggtacctttggtgacatcggaaccgttagtttttatccggctcaccatatcacaatgggtgaaggcggtgctgtattcaccaagtcaggtgaactgaagaaaattattgagtcgttccgtgactggggccgggattgttattgtgcgccaggatgcgataacacctgcggtaaacgttttggtcagcaattggggtcacttcctcaaggctatgatcacaaatatacttattcccacctcggatataatctcaaaatcacggacatgcaggcagcatgtggtctggctcagttagaacgcgtggaagagtttgtagagcagcgtaaagctaatttttcctatttgaaacaaggtttgcaatcttgcactgaattcctcgaattaccagaagcaacagagaaatcagatccatcctggtttggcttccctatcaccctgaaagaaactagcggtgttaaccgtgtcgaactggtgaaattccttgatgaagcaaaaatcggtacacgtttactgtttgctggaaatctgattcgccaaccgtattttgctaatgtgaaatatcgtgtagtgggtgagttgacaaataccgaccgtataatgaatcaaacgttctggattggtatttatccaggcttgactacagagcatttagattatgtagttagcaagtttgaagagttctttggtttgaatttctaatttttgagggggggggattcccctctatgatttcatgaaaattctaataatgggagcgtttgggttccttggatcacgacttacatcctacttcgaaagtcgacatactgtgattggcttagcaaggaagaggaacaatgaagctaccataaataatattatttacacgacagaaaataattggatcgaaaaaatactagaatttgaaccgaatattattattaacactattgcttgctatggaagacataacgaacctgcaacagctttaatagaaagcaatattcttatgcctatcagagtattagaatctatctcatcacttgatgcagtattcataaattgtggaacatcactgccaccaaatacgagtttatatgcatatactaaacaaaaagcaaatgaactcgccgccgccattatagataaagtttgcggtaaatatatagagttaaaattggagcatttctatggagcttttgatggagacgataagtttaccagtatggttattagacgttgtttaagtaaccagccagtaaagttaacatctggtttgcaacagagagatttcttgtatataaaagatctactaacagcgttcgattgtattataagtaatgttaataatttccccaaatttcatagtattgaagttggtagtggagaggcgatatcaattcgtgaatatgtagatactgttaaaaatatcacaaaaagcaattctataattgaatttggcgtggtcaaagaaagagtaaatgaattgatgtatagttgtgctgatatagcagaacttgaaaaaataggatggaaaagagagttctctcttgttgatgcattaactgaaataattgaagaggaagggaaatgaagcttttaattaccggtggatgtggcttccttgggagtaatcttgcctcctttgctttaagtcaagggattgatttaattgtattcgataatctatcacgtaaaggtgcaacagataatttacattggttatcctccttaggaaactttgagtttgtacatggtgatattcgcaacaaaaatgatgttacaagattaataactaagtatatgcctgatagctgttttcatcttgcaggtcaagtggcaatgactacatctattgacaatccttgtatggattttgaaattaatgtaggtggaactttaaatttacttgaggcagtacggcagtataattcaaattgtaatataatttattcatcaacaaataaagtatacggcgatcttgagcaatataaatacaatgaaacagaaactagatacacttgtgtagataagcctaatggatatgatgagagcacacaattagatttccactcaccatatggttgttcaaaaggtgctgcagaccaatacatgcttgattatgcaaggatttttggtttgaatacagtggtgttcaggcattcatcaatgtatggtgggagacagtttgctacttatgatcaaggctgggtaggttggttttgtcaaaaagcggttgaaattaaaaatggtattaataaacccttcactatttctggtaatggtaagcaagttagggatgttttgcatgctgaagatatgatttcgttatatttcactgccttggcaaatgtatcaaaaattagggggaacgcttttaatattggtggtaccattgtcaacagcctatcattacttgaattattcaaattgcttgaagattattgcaacatagatatgaggttcactaatttacctgtaagggaaagtgatcagcgtgtttttgttgcagatattaaaaaaatcactaatgcaattgactggagcccgaaagtctcggcaaaagatggtgtccagaaaatgtatgattggactagttctatatgatgtttctgcccgcgaaagcgggcataattaaagaatgaaatattttttataattaaaagatgaagctgacgtgaggaaactgaggttggttagaattccaagacatcttattattgccgcttcctcttggctttcaaagataataattgccggtgttcagttagtaagtgttaaatttcttttagaaattcttggcgaagaatcatacgctgtatttactcttttaactggattattggtctggtttagcattgcagatattgggattggtagtagtctacaaaattatatatctgagttgaaagctgatagaaaatcatatgatgcatatatcaaggccgcagttcatattctattcgcatccttaatcattttaagctctacattattcttcttatcagataaattatcgtcactatatcttacttcatttagcgatgaattgaaaaacaactcaggaagttatttttttatagcaagtatattatttatattcatcggcgttgggagtgtggtctataaaatattatttgcggaactgttagggtggaaagctaatataattaatgcattatcttatcttttaggttttttagatgtagttgcgatccattatttaatgccagattcgagtattaccttcgctttagtagcattgtatgctccggtagcaatactgcccattatatatatatcgtttcggtatatatatgttcttaaagcgaaagtaaactttaacacctataaattattactatcacgttcatcagggtttctgattttttcgtccttatcgataatagttttacaaactgattatattgtgatgtctcagaaattatctgctgcagatattataaaatatactgtaacgatgaaaatatttggtttaatgttttttatttatactgcggtattacaagcattatggccagtatgtgctgaattacgagtgaaaatgcagtggagaaagctgcatagaatcattttcctaaatattattggtggggtattttttattggtcttggtacgttatttatttatgttttaaaggattatatctatagcataattgctaacggtatagattataatattagtggggttgtttttgttttactggctgtgtattttagtataagagtttggtgtgatacatttgctatgttacttcaaagtatgaaccaattaaaaattctttggctcatagttccgtgtcaggcattaattggtggtgtgactcaatggtattttgcagagcattatggaatagttggtattttatacggactaattttatcgttctcgctaactgttttttggggattgccagtgtattatatgtataagagtaaaaggctagcataatatgaaggtatcattttgtatcccaacgtataatcgagtaaaattcattgaagaccttcttgaaagtattaataatcaatcttctcactccttaattgtagaagtatgtatttcagataatgcatcaactgatggaactgaagaatcaataaatatctggagagatagatttaattttccaattttatatcaaaggcataacgaaaatattgggccagataggaattatttatctgcagttaatatggggactggagattattgttggattttcggaagtgatgatattcttacaaaaaattcccttgcattgatggaagataaattggctgccggaagtgacatttatttatgtgacagacgagaattagatatttcaatgacgaaaatatctaatccacatcggcgatggttaaatggtggcagtagattattttcttttagcaatgaagctgatttgatagagtactttagtaaatgtaactcagtcggcggactttttagctacttaagctctattatagtgaaaaggaataaatggtctgacgtcttatttgacgagtcatacattggtacagcttatgcgcatgtatatattttattaagaataattaacaatatgaattcgaccctgcagtacatatcactgccactggttgattgcagaggagataacgatacattcgaaagtaatgggaaggctcgtcgaataaaaattgatttcatcggttatttaaaactgagggaggatttttataataacaatacaaaaatatatatctcatttggacgggttcttacaaaagagcgtccttggctttatacttctttagctatggcatgttatggtgattctaccgatagagctgaacttgcatcattttataagaagttgggatatccgaaaatagccaccaatttaatattttgtcttaaagggctggctagctacactaaaaaaataaaattagcaaaaatggtaataaaaaaaatattttcatagtatcaacatcaatacaaatcgagtttatagtgtaaaaaatgcttatgctattattgtcgtgactatttagcgtaaagtttatacgtgttttgtaggatgatttatttgcaatttccttaattagaacctttaaatactcttgctttttcggatacagtaacagatgctatatatgtatctataatatgtatggccggggttgtttttgactatttatcaatttcaaaattaagacttgtggcaattagagcttgtcggaaaccctacttttctttcttttgctcactatgctcttgcatatcttagtgtttaccatagagtgagtatattatgacagatgctattttttgtggcatttttacttggtataatatttggcttagtattatgaactgattttaatggtgattttataataattacaaggcttgcttatatttatttggatatgattccttattcatttttaattatgatccgtggttcattttaatgaaaatgtttcctaataactattggtcgttcttgtgataatcgctatacaagcatgaatggaaaaacggagagctattcaatgatcgttaacctatcacgtttaggtaaaagcggtacggggatgtggcaatactcgattaaatttttaacggctctgcgagaaatagctgatgttgacgcaataatctgtagcaaggtacacgctgattattttgaaaagctcggttatgcagtagttactgttccgaatattgttagcaacacatcaaaaacatcgcgacttagaccattagtatggtatgtatatagttactggcttgcgctgagggttttaattaagtttggtaataaaaaattggtgtgtactacgcatcacactattcccttactgagaaaccaaacgataaccatacatgatataagacctttttattatccagatagtcttattcagaaagtgtattttcgctttttattaaaaatgtctgttaagcgatgtaagcatgttttaacggtatcttataccgttaaagatagcattgctaaaacttataatgtagatagtgagaaaatatcagtaatttataacagcgttagtaaatctgattttatacaaaaaaaagaaaaagagaattactttttagctgttggagcaagttggccacataaaaatattcattcattcataaaaaataaaaaagtttggtctgactcttataatttaattattgtatgtggtcgtaccgactatgcaatgtctctccaacaaatggtcgttgatctgaaactaacagataaagtgacttttttacatgaagtctcatttaatgaattaaaagttttatattctaaagcctacgcgcttgtttatccatctattgatgagggttttggcatacctcctattgaagcgatggcatcaaatactccagttatagtgtccgatataccagtatttcatgaagtgttaaccaatggtgcattatatgtgaatccggatgatgaaaaaagctggcagagtgcaattgaaaatatagggcagttgcctgatgcaatttccagatttaacaactatgtcgcacggtatgactttgataatatgaagcagatggttggcaattggttggcggaatcaaaataaatgaaaataacattaattattcccacatataatgcagggtcactttggcctaatgttctggatgcgattaagcagcaaactatatatccggataaattgatcgttatagactcaggttctaaagatgaaacggttctgttagcctcagacctgaaaaatatatcaatatttaatattgactctaaagattttaatcatggaggaaccagaaacttagcagttacaaaaactctggacgctgatgttataatttttctaacacaagatgcaattctcgcggattcggatgcaattaaaaatttggtttattatttttcagatccattgatagcagcggtttgtggtagacaacttcctcataaagatgctaatccccttgcagtgcatgctaggaattttaattatagctcaaaatctattgttaaaagcaaggcagatatagaaaaatttggtattaaaactgtatttatgtccaattcttttgctgcctatcgccgttccgtttttgaagagttaagtgggtttcctgaacatacaattcttgccgaggatatgtttatggcggctaagatgattcaggcgggttataaggtcgcctactgcgctgaagcggtggtaaggcactcccataattataccccgcgagaagagtttcaacgatattttgatactggtgtatttcatgcttgttctccgtggattcagcgtgactttggcggagccggaggagagggtttccgattcgtaaaatcagagattcaattcctgcttaaaaatgcaccgttctggattccaagagctttattaacgacctttgctaaattcttgggttacaaattaggcaagcattggcaatctttaccgttgtctacatgtcgctattttagcatgtacaagagttattggaataatatccaatattcttcgtcaaaagagataaaataaatgtcttttcttcccgtaattatggctggcggcacaggtagccgtttatggccgctttcacgcgaatatcatccgaagcagtttttaagcgttgaaggtaaactatcaatgctgcaaaatactataaagcgattagcttcactttctacagaagaacccgttgtcatttgcaatgacagacaccgtttcttagtcgctgaacaactccgtgaaattgacaagttagcaaataatattattctcgaaccagtaggccgtaatactgcaccagcgatcgctcttgccgcgttttgtgcgctccagaatgctgataatgctgatcctcttttgttggttcttgctgcagatcatgtgatccaggatgaaatagcgtttacgaaagctgtcagacatgctgaagaatacgccgcaaatggtaagcttgtaacttttggtattgttccaacgcatgctgaaacgggttatggatatattcgtcgtggtgagttgataggaaatgacgcttatgcagtggctgaatttgtggagaaaccggatatcgataccgccagtgactatttcaaatcagggaaatattactggaatagcggtatgtttttatttcgtgcaagctcttatttaaacgaattgaagtacttatcacctgaaatttacaaagcttgtgaaaaggcggtaggacatataaatcccgatcttgattttattcgtattgataaagaagagtttatgtcatgcccgagtgattctatcgattatgcagttatggagcacacacagcatgccgtggtgataccaatgagtgctggctggtcggatgtgggatcctggtcctcactttgggatatatcgaataaagatcatcagagaaatgttttaaaaggagatatcttcgcacatgcttgtaatgataattacatttattccgaagatatgtttataagtgcgattggtgtaagcaatcttgtcattgttcaaacaacagacgctttactggtggctaataaagatacagtacaagatgttaaaaaaattgtcgattatttaaaacgaaatgataggaacgaatataaacaacatcaagaagttttccgctcttggggaaaatataatgtgattgatagcggcaaaaattacctcgtccgatgtatcactgttaagccgggtgagaaatttgtggcgcagatgcatcaccaccgggctgagcattggatagtattatccgggactgctcgtgttacaaagggagagcagatttatatggtttctgaaaatgaatcaacatttattcctccggatactattcacgcgctggaaaatcccggaatgatccccctgcagttaattgagattcaatcaggtacctatcttggtgaggatgatattattcgtttagaacaacgttctggattttcgaaggagtggactaatgaacgtagttaataatagccgtgatgttattcattcatcaggtattgtgtttggaacgagtggggctcgcggtcttgtaaaagattttacacctcaggtatgtgctgcttttacggtttcatttgttgccgttatgcaggaacatttttcctttgataccgtagcattggcaatagataatcgtccaagtagttatgggatggctcaggcgtgtgctgctgcattggcagataaaggcgttaactgtattttttatggtgtggtaccaaccccggctttggcctttcagtctatgtctgacaatatgcctgcgataatggttacgggaagtcatattccattcgagcggaacggcctcaagttttatcgtcctgatggtgaaatcacgaaacatgatgaggctgcgatccttagtgttgaagatacgtgcagccatttagagcttaaagaactcatagtttcagaaatggctgctgttaattatatatctcgttatacatctttattttctactccattcctgaaaaataagcgtattggtatttacgaacattcaagcgctgggcgtgatctttataagcctttatttattgcattgggggctgaagtcattagcttgggtagaagcgataactttgtacctatagatacagaggctgtaagcaaagaggatcgggaaaaagcacgctcatgggctaaagagttcgatttagatgccatattctcaacagatggggatggtgatcgtcctcttattgctgatgaggccggtcagtggttaagaggcgatatattaggtctattatgttcacttgcattgggggcagaagcggtcgctattcctgttagttgtaatagcataatttcttctggccgcttttttaaacatgttaaacttacgaaaattggctcgccttatgttatcgaagcttttaatgaattatctcggagttatagtcgtattgtcggttttgaagccaatggcggttttttattaggaagcgatatctgtattaacgagcagaatcttcatgccttaccaactcgtgatgctgtattaccagcaataatgctactttacaaaagtaggaatatcagcattagcgctttagtcaatgaactcccaactcgttacacccattctgacagattacagggaattacgactgataaaagtcaatccttaattagtatgggcagagaaaatctgagcaacctcttaagctatattggtttggagaatgaaggtgcaatttctacagatatgacagatggtatgcgaattaccttacgtgatggatgtattgtgcatttgcgcgcctctggtaatgcacctgagttacgctgctatgcagaagctaatttattaaatagagctcaggatcttgtaaatataacgcttgctaatattaaaaaacgatgcttgccgtaaaagaattgaatgttatttacttaatatgcctattttatttacattatgcacggtcagagggtgaggattaaatggataatattgataataagtataatccacagctatgtaaaatttttttggctatatcggatttgattttttttaatttagccttatggctttcattaggatgtgtctattttacttttgatcaagtacagcgatttattcctcaagaccaattagatacaagagttattactcattttattttgtcagtagtatgtgtcggttggttttggattcgtttgcgacattatacataccgcaagccattttggtatgagttaaaagaaatttttcgtacgatagttatttttgctatatttgatttggctctgatagcgtttacaaaatggcagttttcacgctatgtctgggtgttttgttggacttttgccataatcctggtgcctttttttcgcgcacttacaaagcatttattgaacaagctaggtatctggaagaaaaaaactatcatcctggggagcggacagaatgctcgtggtgcatattctgcgctgcaaagtgaggagatgatggggtttgatgttatcgctttttttgatacggatgcgtcagatgctgaaataaatatgttgccggtgataaaggacactgggactatttgggatttaaatcgtacaggtgatgtccattatatccttgcttatgaatacaccgagttggagaaaacacatttttggctacgtgaactttcaaaacatcattgtcgttctgttagtgtagtcccctcgtttagaggattgccattatataatactgatatgtcttttatctttagccatgaagttatgttattaaggatacaaaataacttggctaaaaggtcgtcccgttttctcaaacggacatttgatattgtttgttcaataataattcttataattgcatcaccacttatgatttatctgtggtataaagttactcgagatggtggtccggctatttatggtcaccagcgagtaggtcggcatggaaaactttttccatgctataaatttcgttctatggttatgaattctcaagaggtactaaaagaacttttggctaacgatcctattgccagggctgaatgggaaaaagattttaaactgaaaaatgatcctcgaatcacagctgtaggtcgatttatacgtaaaactagccttgatgagttgccacaactttttaatgtactaaaaggtgatatgagcctggttggaccacgacctatcgtttcggatgaactggagcgttattgtgatgatgttgattattatttgatggcaaagccgggcatgacaggtctatggcaagtgagtgggcgtaatgatgttgattatgacactcgtgtttattttgattcctggtatgttaaaaactggacgctttggaatgatattgccattctgtttaaaacagcgaaagttgttttgcggcgagatggtgcgtattaagcttaccgagaagtactgaataataattgtataaaatagcctgcgtaaaatctgaacgcatcaatcgctaccttaatatcatacctttgagttaacatactattcacctttaacctgccatgaccgtttgtggcagggtttccacacctgacaggagtatgtaatgtccaagcaacagatcggcgtcgtcggtatggcagtgatggggcgcaacctcgcgctcaacatcgaaagccgtggttataccgtctccgttttcaaccgctcccgtgaaaagaccgaagaagtgattgccgagaatcccggcaaaaagctggtgccttattacacggtgaaagagtttgttgaatccctcgaaacgcctcgtcgtatcctgttaatggtgaaagcgggtgcaggtactgatgcagctatcgattcgctgaaaccgtatctggaaaaaggcgatatcattattgatggcggtaacaccttcttccaggacacaatccgtcgcaatcgcgagctgtctgcggaaggttttaactttatcggtaccggtgtttccggtggtgaagagggcgcgctgaaagggccatctatcatgcctggcggtcagaaagatgcctatgaactggtggcgccgatcctgacgaagattgctgctgtggcagaagatggcgaaccgtgcgtgacctatatcggcgccgatggcgcgggtcactacgttaagatggtccacaatggtattgaatatggcgatatgcagcttatcgctgaagcttactccttgctgaaaggcggcctgaatctcagcaatgaagagttggcgaacacttttactgagtggaataacggcgagctgagcagttatctgatcgacatcactaaagacatcttcactaaaaaagatgaagacggtaattacttgatagatgttattcttgatgaagccgccaacaaagggaccggtaaatggaccagccagagcgcgctggatctgggcgaaccgctgtcgctgattaccgaatccgtctttgcgcgttacatctcttcgctgaaagcgcaacgtgttgccgcatctaaagtgctctccgggccgaaagcgcagccggcgggcgacaaagcggaatttatcgagaaagtgcgtcgcgcgctgtatcttggcaagatcgtctcctatgcgcagggcttctcgcagctacgcgccgcgtctgatgaatatcactgggagcttaactacggcgagattgctaagattttccgtgcgggctgtatcattcgcgctcagttcctgcagaagatcaccgatgcttacgcagaaaacgccggtatcgctaacttgctgttagcgccttacttcaagaaaattgctgatgagtaccagcaggcgctgcgtgatgttgtggcttacgcggtgcagaatggcattccggtgccgacattctctgcggcagtggcctactatgacagctatcgcgccgcagtactgccagctaacttaattcaggcgcagcgtgactactttggtgcgcacacctataaacgtactgataaagaaggcattttccataccgagtggttggaataatttctgcaagcttgtttaagcccggtttaatactgggcttttttttatctctattcttattgatttatcgcttttgcttaatattaacttaataatctgtgtttatcgtaatgaagataatctgaattgttttcgtctgcgttgcactttatatactcaggcgttaaaactttgatatcttatcaggatgcgaaatacatcatgattcataattaagttaattctgagagcgaataatgaaaatcacgatatccgggacgggttatgttggcttgtctaatggtttgcttattgcacaacaccatgatgtggtggcgttagacattgttcctgcccgtgttgaactgttaaatgatcggatatctccgattgttgataaagaaattcagcaatttttaaaggaagataacatcagattcagggcaacgctggataagtttgatgcataccagaatgcagattacgtcatcattgctacgcctacagattacgatccaaaaaccaactattttaatacgttcagtgtagaatcggtcattcaggatgtgatcagcatcaaccccgcagccgtgatgattattaagtctacggtgccggttggctttacggcggcaatgcgtcagaagtttgcgacagaaaatatcattttctctccggaatttttacgtgaaggtaaagccctttacgataacctttatccctcccgtatcgtgattggggaacagtctgagcgcgcccgagaatttgccgcattactccaggaaggcgctattaaacaggagattccgacgctgtttacggactccactgaagcggaagccattaaacttttcgccaatacttacctcgccatgcgagtcgcttattttaatgaattagacagttatgctgaaacgttaggattaaatacccgacaaattattgaaggggtgtgcctcgacccgcgtattggcaatcattacaataatccctcttttggttatggcggatattgtttgccaaaagataccaaacagttgctggctaattatcagtcagtgcctaataatattatctccgctatcgttgaagcaaaccgtacgcgtaaagattttattgccgattctatccttgccagaaagcctaaagtggtgggcatttatcgcctgattatgaagagtggctccgataacttccgcgcctcatcgattcaggggattatgaaacgtattaaagcgaaaggcgtagaggtcatcatctatgagccggtaatgcaagaagaaactttctttaactcacgtcttgaacgtgatttgcactgctttaaacagcaggcggatgtcattatttccaatcggatggcggcagagcttttggatgtcgctgaaaaagtgtatacccgcgatcttttcggtagtgattaataaggcaatcggggctgatgagtcccgatgatttattgaccaaatggaaataatgtctgatttttatcattaatcctatggcatatattttctttatgactacactgtctccagcttcatcctttttttagttagggtatctatgacagtggatagtaatgcgtcttccgggcgtgggaacgatccggaacagattgatttgattgagttattgctacagttatggcgtgggaagatgaccattattgtagccgttattatcgccattttgctggccgtaggctacctgatgatagccaaagaaaaatggacatccacggcgattattacccaacctgatgccgcgcaggttgccacctataccaacgcgctcaacgtcttgtatggcgggaatgcccccaaaatctctgaagtgcaggcgaattttataagccgctttagttctgcgttttccgcattatcggaagcgctggataatcagaaagagcgggaaaagctcaccattgaacagtcggtaaaggggcagacgctgccgctctcggtttcttatgtgagcactaccgctgaaggggcgcagcgtcggctggcggaatatatccaacaggtggatgaagaggtcgctaaggaactggaagttgacctgaaagataacatcacgctgcaaaccaaaacgttgcaggagtcccttgagacgcaggaagttgtggcgcaggagcaaaaagatctgcgtattaagcaaatcgaagaagcgttgcgctatgcggatgaggccaaaatcacgcagccgcagattcagcaaacccaggatgttacccaggacacgatgttcctgttggggagcgatgcgctaaaatcgatgatacagaacgaagcgacgcgtccactggtcttttctccggcctattaccagacgaagcagacactgctggacattaaaaatctgaaagtgactgccgatacggtgcacgtctatcgttatgtgatgaagccgacgctgccggtccgtcgcgatagcccgaaaacagccattaccctcgtgctggctgtgttgctgggcgggatgatcggcgccgggattgtgctggggcgcaatgcgctacgtagctataagccaaaagccttgtaagcttctttgccggatggtggtcggcttcgaaaggtaaaatttctcattaaaaaaccgggcattgcccggtttttttacgcttattgatgacgcttacgaagatcgtcgatcacggtggtgaggttgagatcctgatcctgcaacagcaccagcaggtggtacatcaaatcagacgcttcattggttaattcaaaacgatcattgacggtggccgccagcgcggtttctacaccttcttcgccaactttttgcgcaatacgtttggtaccgctggcgtacagtttcgccgtgtaagagctggccggatcggcggttttgcgctctgccagtagctgctccagttgatacaggaataaccactgatggctggcgtcgccaaagcagctgctggtacctttgtggcaggtcggcccgacagggtttgccagcaccagcagtgtatcgttgtcgcaatctggcgcaatgctgacgacattcagcacatggcctgaggtttcgcctttggtccataaacgctgtttcgtgcgtgagaagaacgtgacatggccggattcaatggttttgtccagcgcttgtgggttcatatagcccagcgtcaatacttcgccggataccgcatgttgcacgatggctggcatcaggccatcggttttttcccagtccagctcgcggcgttgttgctctgttaacatatcctgatctccacgccctggcctgccaggtacgcttttaattcgccaatattgatgatttgcttgtgaaaaacggaggcggcaagcgcgccgtcgacatcggcatcacggaatgcctcaagaaagtgttccatcgtgcccgcgccgccggaggcgatcagcggcacgcggcaaacgtcacggacttttttcaactgcgtcagatcataaccgttacgcacgccgtcctggttcatcatattcaggacgatttcccccgcgccgcgctgttgtacctcttgcacccagtccagcgtctcccactgcgtcacgcgggtacggttttcatcgccggtatactggttaacatgatatttccccgtggcgtcgtcaaaccaggtatcaatcccgacgacaatgcactgcacgccaaaacggtcagccagacgggtaatcagcgttgggtcagccagtgcaggggagttgatagagatcttatccgccccgaaagagagaattttggcggcgtcgtcaattgaccggataccgcccgctacacaaaacggaatgtcgatcacctcggcaacgcgcgctacccagcttttatcgactacgcgaccatcgctggaggcggtaatgtcatagaacaccagttcgtccgcgccttcgtcggcatagcgtttggccagcggaacgatatcgccaatgatctcatggttgcgaaactgtacgccttttaccacctgaccatcacgaacgtccagacacggaattatacgttttgccagcattggatggcctccttaacggtaaatttcccttccaacagcgcgcgtccgacaatcacgccgcgcacgccggtgccgcgcagggcggcaatatcatcgatatcgccaataccgccggaggattgaaaggcgatctgcggatatctggcgcatatctcttcgtacagtgaaacgttagagcccgccagcgtgccgtcgcgagaaatatcggtacacagtacatgtttcaggccgacggggagataggtctccaccagttgttccagcgagacgccggaattttcctgccagccgctaaccgccacctgcttgttgccgtgttcgtctatgcgaacgtccagcgccagtaccagcgcctgcgcgccaaaacgttcaaaccagcctttcaccacgtcaggggatttcaccgccgttgaaccgatgaccacacgggcaacgccagctttcagtaatgccgcaacgtcttcttcggtacgcacgccgccgccgacctgaacaggcacgttcacgcccgcgaccagagttttaatcagcggtatctgtcgcttagccggatctttagcgccggtcagatctaccagatgtagcaccccggcgccctgggcggcgtaatcctgcaaacggggcaggggatcgttaccgtaatcccgctgccgggcgtagtcgccctggtggagacgcaccacggtgccgtcaattaaatctaatgccggaataatcattacatctccaggaagtttttcagcaactgtgcacccgccgcgcccgaacgttccggatggaactgtacgccgaagaaattatctttctgtaccgccgcggtaaacggctcgccgtaattgcactgggcgatagtccacgggttgaccggcatcgcgtagctgtgaacaaagtaaaaataggcgccatcttcaatgccctgaaacagccggttgcccgcctgcggatacacgcgattccagcccatgtgtggcagcggcagaccaaagtcggtcattttcggcacatcttgttcgataatgttcagcagatccacgccgcgtgtctcttcgctgcgacgacccagcagttgcatccctaagcagatacccagtaccggctgagtacacgctttaattaagtcgatcagttcacgttcgcgcagttgatccatagcggcttgcgccgtgccgacgccgggcagaaagagtttgtcagcgcgtaatacgatttccgcttcgcggctgaccaccggggtgtaaccgtggcgcgccacggcggattttaccgagcttaaattggcgcagccggtgtcaaggatgacgacgttcatcacagcactcctttcgaggacggtaatgtatcgccctccacgcgaatagcctggcgtagcgtccgaccaaaggctttaaacaaactttcgacacggtggtgatcgttcttacctttagtcttgagatgcagagtgacgcccatcgtgtaagagagtgagcggaaaaagtgttcaatcatctctgtgctcaaatcgcccacacgctggtaggtaaattcagctttatattccagatgcggacgaccggaaatatccagcgcgcagcgcgccagacattcatccatcggtagtacaaagccaaaacggcagataccgcgcttgtcgccgagtgccagttttaacgcctcaccgagcgccagcccggtatcttctaccgtgtggtgatcgtcgatatagagatcgcccttaacggtaatctccatgcgaaagccgccgtgggtggcgatttgatcgagcatatggtcaaagaagccgacgccggtattaatcttgctgttgccttcgcgatccagccagacgctgacatcaatctgtgtctctttggtgttgcggaccacatgcgcatagcgatcgcgtttcgttagctgttcgccaatcatcgtccagttcaacgtttcacggtgatagcgtaaaccagtaatgcccatattatcagcgagttggatatcggttgcacgatcgccaatcacatagctgttggcgctatccatcgcttgttccgcaagataacgctccaccagcttcactttgggcttgcggcagtcgcagtcgtctgcgggcaggtgagggcagatcagcacctcatcaaagcatacgccctgagaagtgaaaatctgcatcatcaggttgtgcggtccgtcgaagtccgcctgcgggaagctttgcgtgccaagtccatcctggttagtgatcatcaccagcttaaaaccggctttttgcagcttcagcaatacgggaatcacctctggctcaaaggccagtttatcaaagtggtctacctgaaaatcgctcggcggttcggaaattaaggttccgtcccggtcgatgaaaagatacttctgactcatactggctccgcacgtaaggcgtcaatgacgcgctggttttcctggcgggtgccgaccgtaatccgcaggcagccgcttaaagaaggttgtttattctgatcgcgtaagataatgccctgatcccataaggatttaaacacgctgctggaggcggtaaaccgcgccagaatatagttggtttcagagtcaaagacgtgttctacgcaggcggtctgttgcagggcattcaccagatactgacgttcctgcactgtctgcgccacgcgatcgcgcattacgtttattccctgcgggctcagcgcttgggcggcgatatccgccactggcgtagaaagcggataaggggcgatcacttttaacagcaggttgatcacctcttcattagccagcgtaaagccgcagcgcagacccgccagcgcaaaagctttcgacaatgtgcgcaggataaccagatgaggatatttaaccagccagcctgccagcgtggcctgcgggcaaaactcaatataagcttcgtcggcgacgactatcgctttaccgcgtgtcaactccagcagcgtgcgcagatcctgcgggttgataagttgcccggtaggattattggggctacaaacgaacaccacttttgcgccgtcaaggttgtcggaaatcccctgtagatccagctgccagttttcaagcgcgggaaccgtccggcgctctacgccaatggtttcggcgctgacgctgtacataccgtaagtgggcggacagtagagaatggcgtctttccccggttcgcagaaggcgcggatcaccagttcgatcccttcatccgcgccgcggctgaccagcacctgctccggctttacgccagcatattgcgcgtagttttcaatcacggcctttggctggcattccgggtagcggttaagcgtttgttgggtgagctgaaactccaccgctgtcgggaattcattcgcgttcagccagacatcgccgttaccgcccagacggcgggcggactgatacggtaccaggttgcggacattttcacgggctaagtctgcgacgctgagagtgttttcagtgctcatgcttgctccttgagggcgtttacgcgcagggtcacggcatttttatgggcggtcagacgttctgccgccgccaatgtttcaatggttgatgccagagcggaaaagcccgctttcgacagttcctgaacggtcatccgtttctggaaatccgctaacccaaggctggaacaggtagcagtatagccataggtcggtaaaacatggttggttccggaagcgtaatcaccggcggattccggcgaccagtcgccgagaaataccgagcctgcgctggtaatcgcatccaccaaatcgcgcgcattgcgcgtctggataattaagtgttccggcccatactgattagagatggcgacgcactgcgctaaatctttggtcacaatcagacgactggcgctcagggcctgccgggcggtgcccgcgcgcggcagttccgccagttgacgttctaccgcctccgccaccttgcgggcaatgtcagcatccggcgtcagcaggatcacctgggaatccgggccgtgctcagcctgggagagcaggtcagaagcgacgaaatccggtgttgcgccgctgtcggcgatcaccagcacttcagacggcccggctggcatatcgatagccgcgccgtcgagacgctggctgacctgacgcttggcttcggttacaaaggcgttgccggggccaaaaattttatccactttcggtacggactcgctgccgaaggccagagcggcaatcgcctgcgcgccgccgacgttaaagatttcctgcacgccacacagttgcgccgcatagaggatttcatcagcgatgggtggcggcgagcacagaaccaccttctggcatcccgcaatgcgcgccggcgtcgccagcatcagcaccgttgagaagagcggagccgagccgccgggaatatacagaccgacagacgcgacgggacgcgtaacctgctggcaacgcacgcctggctgggtttccacatctacaggcggtagcgtctgcgcggaatggaacgtttcaatatttttgacggcagcggccatcgcctgttttaattcgtcgctcagacgcgcgccggcggcggcgatctcttcaggggtgacgcgtagcgctgtcacttctgttttatcaaatttagcgctgtattcacgcagggcatcgtcaccgcgcgtttttacattatacagaatatcgctgaccgtccgggtaatactgtcagaggcggaaatcgccggacgcgtcagcagcgcacgctgctgttcagggctacagctgttccagtcaatcagggtattgaagctcatggtctttactccatcacagggttccgccttatccggcctactgaacccaaaatatcaacgcattacgtaggcctgataagcgcagcgccatcaggcgtcagatcactccatcatcttctcgatcggcagtaccagaatcgagctggcgccaagcgctttcagtttctccatggtttcccagaacaacgtttcgctgctgaccatgtgcatcgccacgcgctgttgctcgcctgccagcggcagaattgtcggcctttcggcgcctggcagcagggcgataacctcttccagtcgttcacttggcgcgtgcatcatgatgtatttcgattcgcgcgcctgaatcacgccctgaatacgggtcagcaatttatcgatcagctgttgcttgctctgtgccatctcaccgtcgcgctgaatcagacaggctttagagcggtagataacttcgacttcacgcaggccgttagcttcaagcgtcgcgccggtagagaccaaatcgcagatagcgtcggccagccccgcgcgcggcgcgacttcgacagaaccatttaacagacacgatttaaaagagacgcctttctggtcgaggtagcgtttgaggaggtgcggataagaggtagcgatacgtttaccgtccagcgcggccgggccgtcccaggcttcgtcaaccggcgttgccagcgataaacggcagccgccgaagtcaagacggcgcagggttaaatagcgtggatcttcgccctgcgcgcggcggttgagtagctcttcttccagcacgttttcgccgataataccgagatcgaccacgccatccatcaccagacccggaatgtcatcatcacgcacgcgcaggatatcaatcggcatgttttccgccatcgcaatcaggcgctgagtgtgtaaattaatttttatgccgcagcgggccagcaattctcgtgaatcatcgcttaaacggcctgatttctgaatagctatgcgtaagcgggtgttgtctaacattctgcgttcctctttatcctgtctgaaccggtctgtatcgcgcgccaaaaaaaaagcccccggaagatgatcttccgggggctttctcatgcgttcatgcaccactggaagatctgaatgtcttccagcacacatcgcctgaaagactagtcaggatgatggtgatgtttaaattgaacgcgtgtcataaaaattccgatgaatgcttattcatttgataccttttaacctaaaccacttttacgccttaaagcaagcgcttttttcatttcgcatttatagtatgaattgtcagtcacggcgggctggcgtagccttatgtataaggcgttaaagtcaggagaaaatggatgaaaaaggtcgcaattgtcggtttaggttggttaggcatgccgctggcaatgtcgctggcagcgagaggctggcaggttaccggcagcaaaaccacccttgacggggtggaagcggcccgtatgagtggaattgaaagctatccgctgcgtctggagccggagctggtctgtgaggcggacgatcttgacgctctgctggatgtcgatgcgctggtgataacactgcccgcgcgccgtagcggtccgggagaggatttttatctgcaggcgatgcaggagctggtcgacagtgcgctggcttatcgtatcccgcgtattatttttaccagttcgacgtctgtttacggcgatgcgcaaggcgtggtgaaagagaatacgccgcgtaatccggtcacggccagcgggcgtaccctgaaggaactggaagattggctgcataatctgccgggcacgtcagtggatattctgcggctggcggggttagtcgggcctgggcgccatcccggacgtttctttgccggaaaaaccgcgccggatggtcaacacggggtcaatctggtgcatcttgaagacgtggttggcgcaattacccttttgctacaggcgccaaaaggggggcacatctataatatatgtgcgccggcgcatccagcccgcaacgtgttttatccgcaaatgacgcgcttgctgggaatggcgccgccgcattttcgtgacgcaccggacaacggcaaagggaagattatcgacggtagccggatttgtaatgagctgggatttgaatatcaatatcccgatccgttggtgatgccgatggagtgagtcgctgtccagcaggtggtcgccatatagcgcaaggggacgagtatgaaaccactgctggacgttctgattattcttgatgcgttagaaaaagaaggcagcttcgcggcggcgtcggcaaaattatttaaaacgccgtccgccctcagttataccgttcataagctggaaaacgatcttaatatccaactgctcgaccgtagcgggcatcgcgcgcgatttacgcgaaccggtaagatgctactggaaaaaggccgtgaagtgttgcacaccgttcgcgagctggaaaagcaggcgattaaactgcatgaaggctgggagaacgaactggtcatcggtgtggatgatacctttcccttttctcttctggccccgcttatcgacgctttttatcaacgccacagcgtgacgcgccttaaatttgtcaatggcgttctcggcggttcatgggagacgctgacgcagggaagggcggatattattgttggcgccatgcgcgcgccgccgcctgacaccggctttggctttgcaagactgggcgatcttgaactggtgtttgctgtcgccccgcatcatccgctggttcatgaagaggaaccgcttagccgccagacgatcaaacgttttcgcgcgattgtggttggcgatagcgtccattcctcgcgatcaatagggtctgaactgctcgacgctcaggaagcgattaccgtgtttgattttaaaaccaagctggagctgcaaattagcggcctgggatgcggctatttaccgcgttatctggcgcagcgatttttggaaagcggcgcgcttatagagaagaaagttgtggcgcaaatcgtctatgaaccggtgtgggttggctggaatgaacagaccgccgggctggccagcggctggtggcgggatgaaattttagcaaataatgctattgctggggtgtatgcaaaatcgccggtttaaaaatcaatcgcttatgaaaaataattttttgaacgcgctcgcattctcttgtcatttcacttcaatttagggcagaatatgccgcttgcaaaaaatgacactaaccgacgttttaatacgcgtcggttatttttttgcttcaaacacatcattcaataccaagaggccgggcttcgtaccggatagatacttacttaaaaatcgacagttgttgtcgctgaggaatccagaaaatggggcaattttttgcttacgcgacggcattcgccgtaaaggagaatgaccatgtcgcataacgttactccaaacacctctcgcgtggaattacgtaaaacgcttacgttagttccggttgtaatgatgggtcttgcctatatgcagccgatgacgctgttcgatacatttggtatcgtttcaggcctcactgacggtcacgtaccgacggcgtatgcattcgcgttaatcgcgattctgtttacggcgttgagctacgggaaactggtgcgtcgctatccttccgcgggttcggcgtacacctatgcccagaaatccatcagcccgaccgttggctttatggtgggttggtcttctctgctcgattatctgttcgcgccgatgatcaacattctgttggcgaaaatttattttgaagcgctggtgccctccattccctcatgggtgttcgtcgtggcgctggtggcctttatgacggcctttaacctgcgcagcctcaaatcggtcgctaacttcaacactgtgattgtggtgctacaggtggtgctgattgcggtcattctgggcatggtggtttatggcgtatttgaaggcgaaggcgccggtacgctggcgagcacccgtccgttctggtccggcgatgcgcacgttatcccgatgattacgggagcgacgatcctgtgcttctcctttaccggctttgacggcatcagtaacctgtcggaagagaccaaagatgctgagcgcgtgatcccgcgtgcgattttcctgaccgcgctgattggcggcctaatcttcatctttgcaacctatttcctgcaattgtacttcccggatatctctcgctttaaagatccggatgcgtctcagccggaaatcatgctgtacgtggcgggtaaaaccttccaggtgggcgcgctgatcttctctactatcaccgtactggcttccggtatggcggcgcatgcaggcgtagcgcgcctgatgtacgtaatggggcgcgacggcgtattcccgaaaagcttcttcggttacgttcatccgaaatggcgtacgccagcgatgaacatcatcctggtcggggcgatcgcgctgctggcgattaattttgacctggtgatggcgacggcgctgattaactttggcgcgctggtcgcgtttaccttcgttaacctgtcggtgatttcgcagttctggatccgtgagaagcgtaataagacgttgaaggatcacttccagtatctgttcctgcccatgtgcggcgcgctcacggttggcgcgttgtgggttaacctggaagaaagctcaatggtactgggcctgatctgggcgggtatcgggctgatttatctggcgtgcgtaactaaaagcttccgcaacccggttccacagtacgaagacgtcgcgtaatcgcgcgtattatcggcaatagtaaaaccggaggcagtgcctccggttttttgtctgccatccagcacgtttaccggatggcggcgtcactatttatccgctctggattaacaatgcccgtcaggcattggtcaattacacaatctcagttgcgtactgccacagtgatttcagcagccccagcttcgttttatcttccgcatactgctgagaaagcatctgcaattcattggcatactgttgtaaaaactctggcgtcagtacctgacggcgatgctccagccagcgctgctgctctgcgtcatccagcgtaccgggaaaattgcgtgcgcggtaattaaacagcagcttctcaatgcgcttatcgacaaaggtaatgtccagcgcgggcaggttacgcggctcggtttcgagtacgattttcatggctgcgcgatcggcatcgctgaaaaaaccatcatagagctgggcatcaacgttatccgaggtggcaaaaggttcggcttcggcgaaaatcgccaccactttgtcgcggacctgcgggttttcacgcagcactttcaggttatccaggcaatgctggcggttaattcccagccggtcggcatcctccgggcgcaaggtattcgcctgcgccagtaccggacatttattgatatgcaccagctttaccggcactgcggcgtgatcgccaagatcggctttggccgtataaagccgctcgcgaagggtgtcgctgtccagctcaagaagaggagaaatatcgcctgctaaatcgaccatgatcaccgcgttacggttttcaggatgccacgccagcggcgcgacccagcttgtattaccgcgccacgcgccaaacatgccggagacatgcaccagcggcttcatttgcggaacgtcaatcagcgccgccagtttatgtttactgcggtggctataaagataatcaaacagtcgcggctggcgtgttttcaccagttgcgccatcgcaatagtggcgtagacatccgccatcgcatcatgcgcgttgctgtgttcgatcccgttcgcctgggttaaatgttccagacgaaagctgggcaggccgtcgtcgttttccggccagttaattccctccgggcgcagcgcataacaggcgcgcatgacatccaatagatcccaacgtgaattatcatgctgccagctccaggcgtagggatcgtaaaagttgcgataaaaaatattgcgcgtgacttcatcatcaaaacgtacattgttgtagcccacaacgcaggttttaggaacggtaaacagcgcatgaatgcgtctggcgaaagcggcttcgttttctcctttctcacgcgcttcctgcggcgtgatgccggtaatcagcactgcgccgggctgcggtagataatcatcggcgggtttgcaataaaacacctccggctcgccaataacgttgaagtcgttatccgtacggagcgcggcgaattgcgcaggtctgtcgagggccggatgcgtaccgaaggtttcgtaatcgtggaagaggaatgtgctctgtatgctgtcgtttttaactgtcacttgatgtacacgcctgatgttatctgtatatgaaatattttattcttttattttgtcgttgattgattgtatttgtacaccaattgatattgttgctaatgttcgtacatgcgatggtgagtacataaacattaaaatcattgagtacaaaatactaaaatgaccatcagcgacactaagctacgctccctctatggtaaaccatattccggcccatctgaaattactgattttgatttagtactgtatggaatttaggccagggtcaatctggccgggatctcaaaaaatgcatggactaaaacgggtctatgtacagagggacacaacgctgtgtcccttaatttcatgcgggttgaggctggactaggcccaggccagtggcaggatggatgacagaacactcgggaaatattttctggcatgacgttgcatactatccaccacaacgctggtacaggtaaaggcgccatggaggccgtgaaaacggtcggaccagtcggtaaactgttcgctggacgggaagatcgccggagacagctcccagtctttctgcatcagcgcctccgcatagcctctcagggccggcggagagtcatgctcagtgccgaaaatggcgctggaggaatagcgtgcgaatgcggtactaagacagaacagggtttccgcctgcttctgtggggtggcgtccgtcaggtgataagcactgaggatgtgctggtagtgtgccgggctgagtttgccttcaggaagcagggggtcaaaaatggtgttcagacgcgacactgaggcatcatcaatcaacttcacggtggaatgtttctgggtcgtggcggcaataaactgctggttcagctccccgtgctcttcagcgctgaggatgatatcaatcagttccccaaagcgtcgctgcacggcctgctgattaaatgcggcgagaaacaccggaaagtcatgacggaataactctaccggagagatttgcgcggtggaaacgttctctccggctcgcagcaggtaaaagttgtcccatgcagtgtcaggagtagggtttagcattgttaacagcgtgtcagtggagagcatcatcgccgtgtctgaatcctgggaggaaagcagcaggaaattatctgcagcgcgggttgtccagtccgggctgccgtcataattgccgaagagcccattatggatgtggggagacaccgttgggtgagcaagatatcgttcataaagcgctgcagctttctggcgggtgccatcagtgcagcccacgcctgtcatacagtgtaaaatcacctgattaaagagtccgttgtgagtggtcatggcggcgttgttcctgtcaaacgaatccagcaacacaggccgtatgcgctgctgataatatgtgtcaggagccggcaggggaacgtcattataggtctggcactggtgggcaaaaaaacgttcctgaacaggcccgagccactcgctgataagcgtactttgcgtatagggggggccagtacgctcaccagcgaactttcaactggccggatacatgcctctgttaagcggccactccgcaatgacttaaccaggtcttccattgcccggactttttcctgactgtatttatcgggcaggctgtcaatggttatcagaatacttttaccattattgtgctcatgatttaaaaatccatccacagcgttctcagtccaaaggagtggcatttgcggccagatatcacctggacgaataaaattttcgccccctgatactgacggaggtgatgaattatccggttcatttaaaataacgccagagaggttggctttgtgacgtataagcgtattttttaatgttgtatcaataaaagagggctgttgttgtgtagtaattgaatactgtaaaacacttcattcatgtctgaattactaaattttgtattactgcagactacatcactcagtgtcaaataagtgaatcggcattcgtcaaaatgtaaatgagatatatcagaataagtaaattttgaatttgaaaagttgaacctcttaataatatcgccgtctcgctccatgaagctgaggggcaatattttgctgaatgtaatattacggaaatctgcgtttgaaaaatcgcgatctgcgggcgtaagagtttctccggctttctgccgtaaaactgcatccgtaagtttcttagcccagtcggcaggtgatgacggggaagacgtagcctgaagtgagagggagggtgatactggtggtgttctaccttcagaaaccgttggcctgttattggctgatacagagacttcaccggggagcggggctgcacctgtcactctgtaattataatcacatgattgatttgcaatatgcttacgcatgagtgctgcagtcatttttgagacatcttcttctgaaatatttttcttatatgtattatttgtatctttaatatttttaacagtaagcaatgtattgtttaaggtattttttctttcggctgaaagaattcttttattttttgtggtagcgatatctcaatcggtgagtcctttcatgttttaaatttttcatttaaagatgcatgcgtatttttaacactggttatttttgaggcgagcccgtttttcgtatgttcacggatggtgttaattaattttttaacctggttaggaatagtagaaaaattaattgcgcctgatgatatcttcattagaattccttatcaacatcattatggaaaaacggtctggatttttaacgccttaaaagtaagctccatatgtcggtatggcgttggagatcacaattcaccatgctatctggcatgtttctttcagaaagtgtccatcctgtcatcatgtcaccgtattgtgggacgctggcgtatctgcggaaaaatccaggcataagagagcgggtcgggtaacggagcccgtatgcacgcaaaaataaacccgcttcgacgctcaaccagcgtttttcgccggcattcgggatatcgtcggcggacgttccggcgagtatgaaaaagaactgcgtaaagcgcgtgaaatcgcttttcaggaaataatcgttttcttttaaatattattacgtgttattggaattgtatcatttttataattaacagtgggttgtttggtaattctgctgattattcgatgacagtccatgtgcgtgttcaggaaatgtaaaatatttataaaataaaaggttttatcatgttggcatgctcatattaacaactatttcaaattgtgattgaagccgacatttcataatacaaattaaatataatcttcagctatatctaataacaggaggttatatgagcattagtcgtcgttcttttttgcagggggtaggcataggctgctctgcctgcgcgctgggcgcttttccgcccggggcgctggcgcgcaacccgattgccggcattaacggtaaaaccacgctaacgccaagtttgtgcgaaatgtgttcctttcgttgccctattcaggcgcaggtagtcaataacaagaccgtttttatccagggcaatccttctgcgccgcagcaggggacgcgcatatgcgccaggggcgggagcggcgtcagcctggtcaatgacccgcaacggattgtaaaacctatgaaacgcaccgggccacgcggtgacggtgaatggcaggtgattagctggcaacaggcttaccaggaaatcgcggcgaaaatgaatgccatcaaagcgcagcatggccccgagagcgtggctttctcttccaaatcgggctcgctctccagccatcttttccatctggctacggcctttggttcgcctaatacctttactcacgcctcaacatgccctgccgggaaagccattgcggcaaaagtgatgatgggcggcgatctggcgatggatatcgctaacacgcgctatctggtttcgtttggccacaatttgtatgaagggattgaagttgccgatacccatgagttaatgaccgcgcaggagaagggggccaaaatggtgagcttcgatccgcgtttgtcgatattttccagcaaggcggatgagtggcacgctattcgtcccggaggggatttagcggttctgctggcgatgtgccacgtcatgattgatgaacaactctacgatgcgtcttttgttgagcgttataccagcggatttgaacagttagcacaggcggtaaaagagacgacgtcggaatgggccgccgcgcaggccgatgtcccagccgacgtcattgtccgggtgacacgcgaactggccgcctgtgcgcctcacgctattgtcagtcctggtcatcgcgcgacgttctcgcaggaagagatcgatatgcggcgtatgatttttacgcttaatgtgctgctcggtaatattgagcgcgaaggcgggctatatcagaaaaaaaacgcgtcggtttacaacaaactggccggagaaaaggtcgcgccaacgctggcgaaactcaacattaaaaatatgccgaaaccgacggcgcaacgaatcgatctggtcgcacctcagtttaaatatatcgccgctggcggcggcgtggtgcaaagcattattgacgcggcgttaacccagaagccttacccgataaaggcgtggattatgtcgcggcataatcctttccagaccgtcacctgtcgttcggacctggtaaaaaccgttgagcaactggatctggtggtcagctgcgatgtctatttgagcgagagcgcggcatatgccgactatctgctgccggaatgcacctatctcgaacgggacgaagaggtatccgatatgtcgggtctgcacccggcttacgctctgcgccaacaggtcgtagagccgattggcgaggcgcgtccgagttggcaaatctggaaagaacttggcgagcagttgggattagggcagtactatccgtggcaggatatgcagacgcgccaactctatcagttgaacggcgaccatgccttagcgaaggaactgcgacagaaagggtatctcgaatggggcgttccgctgctattacgcgaaccagaatccgttcgtcagtttacggcgcgttaccccggcgctatcgcgacggacagtgacaacacctatggcgaacagcttcgcttcaaatcgccctccggcaaaatcgaactttattccgcaaccctggaggaattgctccctggctacggcgttccgcgcgttcgtgactttgcgctgaaaaaagagaatgagctttacttcattcaaggcaaggtggccgtgcataccaatggcgcgacgcagtacgtacctttactcagcgagctaatgtgggataacgcggtctgggtccatccgcaaacagcgcaagaaaaaggcattaagaccggcgatgagatctggctggaaaatgccacgggtaaagagaaaggtaaggcgctggtgacgcccggtattcgcccggatacgctttttgtctatatgggatttggcgctaaagctggggctaaaacggcggcgacgacacacggtatccactctggcaatttactgccgcacgtgacgagtccggtatccggtacggtagtgcataccgcaggcgtgacgctgagccgggcatgagggaggagggaaccatgaatcatttaacgaatcagtacgtcatgctgcatgatgaaaaacgttgtatcggctgccaggcgtgtaccgttgcctgcaaagtgcttaatgacgtaccggagggatttagccgcgtacaggtacaaattcgcgcccctgaacaggcatccaacgcactaacccattttcaatttgtccgcgtctcctgtcagcactgtgaaaatgcgccatgtgtcagcgtttgtcctaccggagcgtcatatcgtgatgaaaacgggatcgtgcaggtggataaatcgcgctgtattggctgcgattattgtgttgccgcgtgtcctttccatgtgcgctatctgaatccgcaaaccggcgtcgccgacaagtgtaacttctgtgccgacacgcggttggcggctggccagtctccggcgtgcgtatccgtttgcccaacggacgcgctgaaattcggcagactggatgagagcgagatccagcgctgggtcggtcagaaagaggtctatcgccagcaggaagcgcgtagcggcgcggtcagtctgtaccgtcgtaaagaagtccatcaggagggtaaagcatgaatactatctggggagcggaactacattatgcgccagattattggccgctgtggttaatttacgcaggcgtcgtggtgctgctcatgcttgttgggctggttatccatgcgttattgcgccggatgctggcgccaaaaacggcgggcggcgaagagcatcgtgactatctctactcgctggcgattcgccgttggcattggggaaatgcattactgtttgttttattactgttaagcggtttatttggtcatttttctctcggccctgtagcgctaatggtacaagtgcatacctggtgtggttttgccttactggctttctgggtcgggtttgtgctgatcaacctcaccacaggtaacgggcgtcactatcgggtaaatttttccggactagtgacgcgctgcatacgccagacccgtttttacctttttggcatcatgaaaggggaagcgcatccgttcgcggcaacagagcagaataagttcaatccactgcagcaactggcatatctggcgattatgtacgcgctggtaccgctgttaatcatcaccggtttgctgtgtctctatccgcaggttgcgggtctgggccctgtgatgctggtgctgcatatggcgcttgctatcatcggcttactgtttatttgcgcgcatctctatctgtgtactcttggcgacacgccgggacaaattttccgtagcatggttgacggctatcatcgtcatcgtaccgcgccgcgcggggataagtccgccgtctgagcgtatccataaaataaagtcagcaagaaaatgtgccttgtgtcacattttcttgcaatttatccatgtttgtttaactgaacttccgtaaaaagaacggcaaattgagaccatcctgaagacatgctgttgaaacgccgtttgtttattgccgcttctttattcgcgatgcacctttctcctgcgcttgcggccgatgccgtaagttttgctccccaaccgccagccattgatgcaggcgcctgggtgttgatggattacactacgggacaggttcttaccgccggtaatgaacaccagcaacgtaatcccgccagccttaccaagctaatgacgggctacgtcgtcgatcgcgccatcgatagtcatcgtatcagccctgacgatatcgtcaccgttgggcgcgacgcctgggcgaaggataatccggtgtttgtcggctcctcgttgatgtttttaaaagaaggggatcgcgtgtcggtacgcgatttaagccgtggcttaattgtggattccggtaacgatgcctgtgtggcgctggcggattatatcgcgggcgggcagccgcagtttgtggcgatgatgaacagctatgtgaaaaaactcaatttgcaggatacccattttgaaaccgtccacggtctggatgcgccgggacaacatagctccgcgtatgatctggccgtactctcccgggcgattattcacggcgaacctgaattttatcacatgtacagcgagaaaagcctgacctggaacggcatcacacagcagaaccgcaacggcttgttatgggataagaccatgcatatcgatgggcttaaaaccggacacacatcgggggcgggatttaatcttatcgcatcggcggtggacgggcagcgtcgacttatcgccgtcgtgatgggagcgaaaagttcgaaaggacgcgaggaacaggcgcgaaaactgttgcagtggggccagcaaaactttgcgacggtgcagattttgcacagcggcaaaaaagtgggcagcgagcggatctggtacggagacaaagaaaagattgcgctgggtacggaacaggatttctgaatggcgctgcccaaagcggaaattccgcatatcaaagcaaaatatgtgctggatagaaaagagctggaggcgccaatcgccgcccatcaacgggtaggtgaaatagagctctacgatcgggataaactgatcgctcagtggccgctggtcactctggaatcggtgggtaaaggcggtatgttctctcgtctgagcgactattttcagcataaagcgtaagccgttgtcacacaccgttcaccgtcatctgaggtgtcaaaagggcgggattgcgaggttgctcacaaaatgatcacgctgtccttgtgaccgtaaaaggctgtaattatactgtacattaatacagtatagtaaagtgacggaggcagcatggattacgaaatcaggcaggaacaaaaacgcaagatagccggtttccacatggtcggtccatgggaacacaccgtgaagcagggttttgaacaactgatgacgtgggtggatcgacagcggatcgtgccagttgaatggattgccgtctattacgacaatccagatgtcgtacctgcagaaaaactccgctgcgataccgtggtgtccgtggcagagaatttcatcctgccggacaatagcgaaggcgtaatcgtgaccgccattgaaggcggcgaatatgccactgctgtcgcgcgagtggaagaccgtgactttgcgaagccgtgggaacggttttttgatgtcctcgagcaggatagcgcttatcagatagcctctgcgccctgttttgaaacctatctgaataacggcatggaagatggatactgggatattgaaatgtatattccggtacagcggaagtgatcgactggtttcctggctgaaaagagcggacggataatgtgttccgtccgccagtgcgctatttttgctataaagcaggtacaatgcattttttgccattcccgtaaggagcgcaagcgtgcgtgccgataagtcattaagcccttttgaaatacggttgtaccgtcattatcgcatcgtgcatggcatacgtatcgccctggcgttcattcttacctttctgctggttcgtctgttttctattcccgagggcacatggccgctaatcacgttagtggtgattatggggcccatctcattctggggaaatgtagtgcctcgtgcttttgagcgcataggcggtacgattctgggcgcggcgttagggctggtggcgctacgcctggagctcttttccttaccgctgatgctggtgtggtgtgcgatagcgatgtttttgtgcggctggctggccttagggaaaaaaccgtatcaggcgctactgataggcataacgctcgccgttgttgtcggcgctcccgctggtgatatgaatacggcattatggcgtggcggggatgtgattttgggggcgctactggcaatgttgtttaccggcatctggccccagcgcgcctttttgcactggcgcatccaactggcgcattgcgtcacggcgtataatcgggtgtatcaggcagcgctgtcgccgaatttgctggagcgcccccggttggataaatatttgcaacggttgctgaacgatgtcgtcaaaatgcgcgggctgataacgccagccagtaaagaaacccggatacaaaaatctattttcgaggccattcagaccatcaaccgcaatctggtttgtatgcttgaattacaaatcaatgcccactgggcgacgcgcgccagccattttgtgatgcttaacacgcacacattgcgtgaaacccagcagatgacgcagcaaaccttgctaacgatcgcccacgcgttgtttgaaggcaacccgcagccggtactagcaaataccggtaaactgaatgatattgctgccgagttgcgacagctaatgaacgagcagcagggcgacgcggtggctgaaacccccatccacggctatgtttggctaagtatggaaacggcccgacagttggaactgctttcacacttgatctgccgggctttgcgcaaataaaaagcagatggggtgaatgaatttgttgctgcttcgattcagcaaagattaagagtatgatactaatataaggataaaatgagtgctactggcaacgattttatccccgaaccttcaggtttccccagacggcgacgtaacggtgtttcttctggcggcttgaagtatgacggggataaacgtaatgtttatccactagcagttgcttaacgaatccgaatctcacattatcaggggtgtaaaaatggaaacaaccaagccttctttccaggacgtgctggagtttgttcgtctgttccgtcgcaaaaataaactgcagcgtgaaattcaggacattgagaagaagatccgtgacaaccagaagcgtgtgctgctgctggacaacctgagcgactacatcaagccaggtatgagcgttgaggcgattcagggtatcatcgccagtatgaaaagcgactatgaagatcgcgttgatgactacatcattaaaaatgccgaaatctccaaagagcgtcgcgacatttccaaaaagctgaaagcgatgggcgaaatgaaacacgccgatgtaaaagccgaataatgcgctacggcagtgggagcgtatatcaggctctcactgcagtttgaccccgcctgtgaccatcttgagtaaatgttgttttggccagtgtcgggtaagttttttctctgccagcttacctttcagacgcgcaatatcatgacgtttccggtccagcatcagacccaccacgctaccgctatgcgccacgttcaatccgtataaatcacactcttcgaccagcgacagcagggcggtaaagcccgacttaggtaacagcgtctggctggcgatagcgctaagcgtagccgcctcacccagtcggagcggattttgcgttatacaggcttcctgcaccagattccaggcctgctgcaaggttggtgaacttgctattaatttctgctggcgagggagacggtggtaatcttgcgtgcgcagtgtgaccgggctttccagtaccagcaaatcgattggcggcggtggctcgcaggcgatttgcgtggccgcattattatgatcaaacagcgttaactgatgaaaaacggtgctatcagtgggttcgattgagacgcaaagctgtgcaagggtggtttcatccagcgaatggccaagatgatgcgccgttgccaccgccgtagcggcaatatctgcggtgctgctggccatgcctttggcaacgggaattgacgaacgcacatcgacgcgaatctcgttactccagtgcgcaggatactgccagtgcgccagaacgcgctccaccatcgcccgcgacaatggacgctcgtttaccaacggcggcgcagccgtgactgctacggtgctgtaccagtcaacggggcaggagaccagtttctcactgcccagaatccatccctggataagttccccgcatgaggcggggcattgcgcaacagccacgttatcacctttcaggtacgaatagtgtgcgcgcatagtgtcatggtaaaagcgttattaccatgacttgccgcaatgcgtcgtatacccctctcaggctggtacacaaagcccttccgtggccggtagcgcaatgcgcataacgtcttgtgcgatcattaactcttcgttggtgttgatgacggcgactttcaccagggcgttctccgtctggataaatgttgcattacgttgatttttctcttcatcaacggctaagcctaaaaattgcaaattatggcaaaccgccgatctggcgcgcgctgagttctcgccaattcccccagtgaataccagagcatccagtcctcccatttgcataatatagccaccaatggtggcgcgaatgcgttcggcaaacagcgtgagagcgagtttagcctgccggttaccggtattggctgcctgttcgacatcgcggtaatcagacgacacgccagaaacgcccagcaagcctgactcattatttaataactgattcaactgttgcggcgttttgcattcgcgctgggctatccacggcagaatagagggatcaatatctccgctacgggtgcccatcatcacgcctgactgcggcgtaaagcccatcgacgtattgaccgaacgtccgttcttgatggcgcagacgctgctaccgtttccaagatgacaacaaatcacccgtaatgcgctgagtggtacgcccagcttttcagccagaacgccgctgacatacttatggctggtgccatgaaagccataacggcgaatccccagttcagcgtaataatgccagggaagcgggtaaatataggcgggttcatccagcgtctggtgaaatgccgtatcaaacacggctacagaaggggcatcaggcaacagttgacgaaaaacgtgaatacccaacgcgtttaccgggttgtgaagcggggccagttcagcaagacgttcgatttgcgctaacgtttcatccgtgaccagcgtcgagtctttaaaaaactcaccgccgtgcgccacacgatggcccaccccgtcaatgtcccgcagactgttaatgatttgataacccagcagcttttccagaagcagcgttaccgcatcgcgatgatcggcaacggggacggtttcctgccatttttggctgtgcgtcttaattgtcacctgcgcatccgccataccgatacgctcaatcagcccctggcagagcatgtcgccctgcggcatctccagcagctggaactttaacgatgagctgccggcgttaatggccattattttgtaagacataaaggttccttcgaattcagaaaatccagcacggcgtcgagacccgaattattcaacgcgctggtaataaaaatctgccgggcgccagcctgcgtaagccattgtgcgaccagcgaaatacgctgcgggtcggcgagatcggctttggtgacaaggccaatcgtcgggcggttcatcgggacggtaaaacccggagaaaacggcgaccactgagcgtcggcatttaacaccagggcgataacgtcggcctcgcaggcgctggtcagcagggcgctgtacaggcagcggttctccaggtattcgcccggcgtgtcgatagccatcggcgaccattcaatggcctgggttttcttgtaatggagcgcttcgccacgcaggctttgggtcagcgaagttttcccgcactggctggggccgataaacatcagacgcttcattggattacgtccgggtgatcgagcaggtagtgaactgcatcatctcgcccagggtgcgcgttacctgcttgagggcatattccacggcggaaacatcgccggtcagcaccacagcaccggtaaagcggtcaagaaaaccaatctccaccgcgccggattttgtagcaatatcgcaggcgataatcgacgcttcgctgggcgtgatggtgaggatgccaatggcggaaaccgcatcctgcaggcccagcttcttaaataaatctttccccggattagcaatcaggtgcgcgagggtcacctgtttccccggcacgtattcctgaatcatgcgatccgttgtcggttgtctttccattatccctccaccatctgtcgccacatggcttcatgcgagcgtgggatcaccgaacggtaaaccagcagccctttttcgcccgcgctttcgctggcgaccgtcacggcgttattgacgtcagaaacgtcgcccgccaccaccatgtagcatttaccgccgatgccgaaggccatatgcacccgcaccagggtgacgtttgagcctttcaccgcccggtctgcggcgctaatgcaggccgccacgctccaggtttcgacgatgccgaccgcctgacgcttatcgacgctgttcaggccgctgatggccggaagtacgctgggatgaatatttgccagcaccaggctgtcgacgagcatctcgccggcctgcgacgtaccggtttcaatggcctgctggatagcgccgatatcgccgcccagcatcagtaaaaacttacttgggcagatggtcttgctgaccagtagatcgacgttggcgcttttcagcatggcatcaccaagctccatgcctttggcgatgctggtgagttctaaaattcctatagcctgagacatggttaacctcttacaacagtgatggcctgttcgctgatggccgaaacaatgccgtcgatgctggcgtgaatggatgcgccgagcgcgccaggcgggacatcggcaacgcattgcccgcgagtcacgcgctcgccgacggcaacagtcggtactgcgctggcaccaatatgctggcgcagctgcaaagtgactttttctactgacggctcttcttcaaccagcggcgcttcctggtaccaggggcttagtcccagtttggcgatcagccgcttcaccggcaccaggcgatatttcgccatttcgtcggccggattcagcggcccttcgtagcgctggttttgcgcccgcagctcgcgttttaacatgcggttgatgcgcatcggcgagatcccgaccgggcaggccacgctttcgcaaacgttgcattccgagcaggtaagggcgctcagcagcagttgcggcgtggcagcctgatgaaagttcaccgcccgcaccagcaggtgcggagagagttcgtggccgatcagatgtcgtgggcagagatcggtacagagtcggcactgttcgcagacggtgcgcgcgacggaaagcactgtgcgctcgtcctgcatcctgcgctggataagcggatggctttttgggagcaccagcaggccgccggtagttttcgtcaccgggttatcaagagaggtaatcaggccacccatcatcgggccgccgttaataaaaccggggttgtcgaccgtcgcgccgccagccagcgccagcacttcatgcagtgacatgccgacaggaacggtaacggtcaacggtctggcgaccgcgccgttcacggtcaacgtgcgacgagtgaccggaaactgctgctcgaccgcccgggcaatattcagcaccgtttgcacgttattgacgactacgccgacgctggcaggcagcgcggcaggggcgacccgacgaccggttgccatccagatagtcagcacctcatcgcccgcgggatatacatccggcaggatatgcaggcggataccggctggcagtagtggggagagggcgtcgatggcccggcggtatttttctttcagggcaatcaccccttcgcgcgcgccggttgccgtcatggcgtactgcacgccgcggacaagacgcgcggcctgctgccacatcagttgctggtcaactttgagcatcggttcacactcggcggcgttcaccagaaaaatctctacctgcgcctgtagcttaacgtgggcgggaaaacctgcgccgcccgcaccgacaacgcccgctgcgcgaacgcgctcacgaatttcatcggcgctaagggacatttaaacgctgttgatggcggcgctcatagcagttcctccagcagttcacgaatttcctcggcgctggccgggcgcgggttggtgcgcaacgtgacatccgccagcgcggcctgcaccatcgctggaatacgtgcggaaaagtcggatcttccttcttttagcgcaacggccagtgagggaagggcacagcgttgcttaagcagttcgatttgctgaatcagcgcattgatcgccgtgacatcgttggcttctgccgggcaaaaaccgcaggctttggccagccgcgcgtagcgtttggctgcgcgcggaactccggcgttaaaacggatcaccgtcgtgagcagcagcgcattggccaggccatgcggaagatgaaactgtccgccaagctggtgggctatcgcgtggttaagccccagccccgcctggctgaaggccatcccggcgagcgttgaggcgttatgcatttttcctcgcgtcgccacgcagtcgcctttttccaccgccgtcggcagatactggaacaccagtttggcggctttttccgccagcgcgtcggtaaagtcgctggcgtgcggtgacacccaggcctccagggcgtgggtcagcacgtccatgccggtgttggcggtaatctgcggcggtacgctgaccaccagctccgggtcgaggatcgccatatccggatacagcgcattgttgaacagcggatacttgatgcctttatccggatcgctaattacgcaggcgctggtgacttccgaaccagtgccgctggtggtcgggatcgccacgcaggtttcgatattgatgccgctttgttggctaaaccagacaatcgctttcgccgcgtccattgccgagccgccgccaaaaccaatcaccacctgcggctgcagggcctgcatttgcgcaatgccctgcaccacggtatggatggtggggtccggcgttatctcgctaaagacgctgatgcggttatctgcgggcagcgcgttacacagggtatccagcagcggcgagcgtgccagaaagccatcgcagattatccagatgtgcttattggtaaagcgcttgagcaccgccaggctgccctgaccgctgtacaaccgcgtttgtagtgagaaggtgttcatcgcgacctcggttagcgaatagaaaagccgttggtcagcacgcagcgccgggagcgggcaaaagtacgcgctgacgttgttccttcaccggttggcgtggcaatggtaaaggtggtaaagccttcgccgccgacgccgatcccggcataagaagggccgtttttgacgaatatcgaggtttgcagggtgcgggccgcgaggttcaggcgcgacacgttctgcgagtgcatgatcgcggtgtgatgcaacccctcttcaaccttcagggccagtgccagcgcgctatcgaaatcgttaacttttaccaccggcagcatcggcatcagctgttctctggtgacccacggatcgtcagcgttaaccagcgcaatcagcagacgcggcgcttttgcagggacagcgatcccggcggcttccagcatggccgatgggctcttgccgaccagttttttattcgcctggccttcaggcaggcagacggcgcggagtttgtcggtatcggcagggcttagcagcagcgcgccgaaggtttgcatttgctgcaccagacgttcggcgacgctctccaccacgatcaggctcttctcggcaatgcagggcaggttgtaatcgaatgacgcgccgttgatgatatcttccgccgctttcaccaggtccgctgtttcatcaacgatgcagggcggattgccagcgccagcgccaatcaccttcttaccgctcttcatgcccatggccacaatgccggggccgccggtaatagccagtaccgcgattcgcgggtgggccatcatctgctgggtcgcttcgaaagtcggttccgccacggtcaccaccagattgcggatgccgcagcagcggaaggcaatctcttcaatcagactaatcagcttcagagagacctttttcgctcccggatgcgggctaaagtagatactattgcccgccgccaacatgctgatgctgttattaatgatggtttccgtcgggttggtgcttggggcgactgaaccgatgacgccaaacggcgagtattcaaagagtaccatgccgccgtcaccggtcagcgcggtggtggtgagatcttctacgcccggcgtgttgtccagagcagccttgtttttgaggaatttatcttctttgttgcccattcccgtttcattggcgctctcctctgccagagcagccagcagcggcgtcagctcctgacgcatcgcgctgataatggcgctgcgggtttttagcgggcactgctgataacgtaagaacgcctgatgcgcggcgtcgatggcctcgctcacggactggaaaatccctttgccctgaggctgggccggtgtttgcgctggcgtggttaattgctcgctaagaatggtgcgaatcagggtttcgagttcagaagtattcattgatgtgttcccacgttaatagccgcgatggcggtctgtgctatgtccatgtcctgctcaacgctgccgccactgatgccaagacccccaattaatatgccgtcgcgccatagggcgtaaccgccgccaaaggtgaccacttttccctgtaaatgactttccagaccgtaaagcgccgcgcctggctgaacgacatcgctcagctcatgggtcgccgttttcatcgccactgcggtccatgcctttttcggtgccagttcgctgctgaccagcagggcgtccggcatccgccaggtcacagtttccgtgccgtgcgcgtcaacgatgctgacgactaccggaacctgcagttgctgcgcgcgttcaacggcggcgcgggtgagctggtgcagatcgtggaatgagagggccacgggcgttgtctccttgctgcgggtcggctggctggcagccagatagcgcttgctaacttcacggatgatgttggcctggtgcgcatcgctatcttccgcgcgggccagggcgtacaggcagtccgataagcggttgatgtagcgcatcagcacttggcgtacgttgacttcagttgccagttcaaccagacggcgttcggcgcggcgcgccagcgtgcgggcaaaatgtaatcggctcgcggcttcgcagcgtccgggtaaaataaagctgtgcagcggttcgacgcgggccattgcccgatcgatagcggcttccagggccgaaatctcttcgctgctgatgtagcgctgtttgggcgatggctgctcgctgtcgctggccagctctgcgctaaaccaaaaaagttgctgctggatggcctcgagtaaggtgcggtgattttcatccgcagcggcgcaggcgcacaggctcagcgcggcgttcagttcatccagcgtgccgtaggcttcaacccgcgggtgggttttgctcacccgctggccggtaaacagtgatgtggtgccagcgtcacctgttcgggtataaatcgccataaccgccccttaacgcgaaagcgtatctacaatgccgacaacggcgaggtcgatggcctcatttggcccggaaaaaacgtgcctggcgctggagccgccgctgagcaaaaccagttcgccgacgcccgcgccgacggagtccacggccacttcatcgccggaggtgggcgaggcggggagttcgccatcggcgctgacccgacgcaccagcagcagcttttcccaatcaaagaaggtgatttttgcgtggagacaaccgcgcccgtgactcgtgccagatgcatgatttactcctgcttaattaattgaatattccgcgcattggccgcgtcacgcgccatggcggtcacgatgcatttgcggtggacaaccacacgcccccggcttagcagcgcgacatcgcgatagcccagcaccgaacccgcatgcagaaccagcggcagtccgtgctcgtcggtgaataccagcggcagacgagccagtttttttaccgggataaccggcagcagctggctgtgcaggctgagctgtacgcggatgccaaacgccagcgcgtcgtgaattttccgggctgcggcatcgtcggtttctgcatccgcaagctgacccagcagcggcaggtcgacgagcaggatgcgcagcgacgcgtgctgacagaacagcgctggacagtcggcatcgcgaagctgcgcaacgctcagcgttgccgtgctcagggcacgacgctgcagtcgggagacaatctcctcgacaatgcgctgcagagtttcgccgttcatcgcgggcctaccagccgggcaaaggcctgcgggttatcggcaccagcggcgttggcttcatcggtatcaatgtgcatttcgaggcgcatgtccggtgaaacgcgaatcgccacattgttgaaaatcagcccgcgctcgtcgccttcaatcgctaccgaaaccctatcgccgtgggagaccttcaggatcagcgcatcaagcggcgacatatgaatatgccgctgcgcgacgataaccccggaaggtagctccagttcgccaaaggggctgaccaggcggatgccaggtgtgcccttcaggttgccggacattctcagcggcgcggcaatccccagtgttctggcatcggtacgcgatatttctacctggcttaccgagcgcagcgggccgagcaggcgcacatttttgagctgtcctttcggccctaccagggtgacggtttgctccgtagcatattgtcccggctgcagtagcgcttttttttcgctgatgggatggccgggaaacagccgctcataatcctgcgcggacaggtggatatgacggtttgagacgcccagcggaataggccgctggcgcatctcgtcgagaactttacggaccgttgattgcagaagctctttatccattacgcttcacctcgcttgccggaatgaatgcaaagcgtacgaggttcgcccttctggcgcggacattttggatccagacacagattgcagctgaccagttctgattcctgcggggcctcttcggctggcgcttcagaaacgacatcagctatctctgacgcttcaggctcaggttcaatgacggagggggagggtgtctctgcgagcaggatcccttctccgggcctggcgataaccttgtgggccaccagaccattccgctgttcggcaaattgcgcaccggtggtgatggccgcctgcacggaggccacatcaccggcaattttaatcaccatccagcctgaaccattggtcttttcgagggcgagcagcgtgatagaagcggatttcgccatgatatcggcgcagctgatagccagtgccagaccacaaacttcaagtaatcccagtgattgcttcacgcggtgctccttattcgccatcgattaggctgatttcggtaaaatggcctcaacatcgctgtgcggacgcgggataacgtggcaggatttcacttcacccacgacgcttgccgccgcgctgccggcatctacggctgctttaaccgcgccgacgtcgccgcgaaccatgactgtaaccaggccagaaccaattttttcgtagcccaccagctgtacgttggcggatttaaccatggcgtcggcagcttcaatggcgcctactaacccttttgtttcaaccagtcccagtgcgttattcatactgcagttctcctgttgcttagctattcagatcccggaaagggatccctttgaccagccgtgccgcgttattaccggtgttgcgttgggcctgactgtcctgatgatgcatcagcgtaaaaagcggcgccgatgcgggtaaattcttgtaatgtacgaccagcgagtgtcgatcgcaggcaatgccgaccagcagcggcgagctgcgcgccgcctgccaggcgctgtcaacgacatctccagctgggtgatgctgaagcaggaaagggatgccttcctcttcaatgcccagcagcacttcgtgccagaggctggcgcagtcgttgatgacggtaatgacgatagccggggcgctgtgattactgtccatatgcaaactccttgtgccaggagagaatcagaccggtggccaccgcgtttcttgggccttcgctgccgcgaatatttcctcgcccggcgactaggcggtagtgcgccagcgcatcggtgaccaactgcggaacttcgaaatccagcgacgagccgccgaccagcaccacgaacggaatatcgcgaatgttgccggttggactgacctgacgcagcgcgcgcagggcgttggtgacaaagacgcgttctttagcgctgcggcgaatggcgcgcactttttccagcgctaagtcgccgggaagcggcaccagttcgtccggtttcaccacgcagacgcgggcgaacaccgcaggaggcagcggcgtcgggaagaactggacgctgccgtcctcgtggcgtaagtggaacaggctttcgaccttagccagcgggtattttttgatctcttccgccagatagcggtcttccagccccagttcgcgggcaataatcatcgtgaccatgtcgcctgccccggcgagatgggtggcgatgatttcacctttagggttgatgatggaggcatcggtggagcccgcgccgaggtcgaggatcgccagcggtcgggtggtacccggcgtggtcagcgcgcccagaatggcggcttcagcctcagcgccgccgatctgcacgtcgatattaagcttctgctcaatttcacgggcaatcatcgccatttgcagacggtctgatttcaccatcgaggcgatgccgacggcctgctccagcgagaactccccggccagaccgccggtgacgctcaccggaaccgaggtgtcaacggccagaagatcctgaatgaaaatctcgctgctcggcttattggttagctcggccatggtctggcgcacatgctccagcatgccgccgatattggtcccggcctcgccgttgacgttgtcgagcttgccgtagccgtccaccgctttcatgatagcttcggcaccggcggcaacatccacgcgcacggtacgaccctgagcctgcagctccaggttaccggcgggtattgcgcgcgctttgacgtcgccggatggcgttttaaccaccacggcggaacggttgccaatcagcgcgcgcgccatcgggacgatgtttttcgtctcatcggcgttgaggttgaatacggtggcgatgccgtaagggttagagagggtttcgataacctttcccggcacggcgacttcaatcgccgccagcatccccagcggaatgcagtcgatgtacagaacttcatcgacaatcggtagcgatttttccagccggttgctgaccagtacgccatcgtcgcgctgcaaaatgacgccggtaatctggtatccggcgcgcattgaggcgttgataacattggcgatatcagcaaaatcaaaggctgacgataccaccagaatataggacgagtccgccgggcgggttaacagctcctccggcgtaatcgtgatacccacaccaaggcctgctccgcccggcgtttttgggttatggccgatcattgtcgattcggtgatgatggtttcggtaatggtttccatcgccacatcgccaatcaccggcgtggcttcgttaatgcggatgagcgaaatatcgctgacattgatccccgcgcgctttgcgacgagggcgagcgcttcctgaatgccgaacacgttacgcaacgtgcctttgatcccggtgttttccgccagcgcgctgtgtgtaatcgttagtgcgccagtctcatcttgccgcgccagtgcgacttccgttgatgagttaccgatgtcaatgccagctatatatcgcatcgtatatcctttttctcgtcgtacttcaaactgcctttttgttggctgcgttctttcacccgaatcacttactacagtaagctcatcggggttatgagggacatccctgtccctcactaaagccagcctatggctgttcaaattcgttccagacgaatttgtcactcacttgccgcctcaatgcatctcgaattacttagagaaagctaatcgtcgcctttgagttttttacgctcaacgtacagccctgccgcttcacgaacgaaagctgcgcaaatctttgcctgataacggttttcgagatcgtcggcgatagcgagcagctcttctttcgttgaacgatacggacgaagggcgttgtagatttcaagaatgcgatcgtccggtaccgcggtcagttcggcggcgcgttcgaagttcatcgccagccggtcgcggcccgcatctttggcgatagacgcctgtaagcgcagggttttcggggtaatacgcatatcctgagcggtgactttattgctcagcacgttttccagcgtaaagtcgtccagcgttttattggtggcggttttcacccattccgggtgtttgttcgccagcgggtagtcgctgacctttgcgctgcgggacgtgccgcctgccgcaggagccgctgctggcgcatcgccctgcaggctgttcatgcggctcaatacgtcccggaccatcgattcaattgcgtcggtattcatggagttatcctttatcaaagcgtcacgcgcagttcctgcgggtttttgcccgtcacgacgtacttggtctctttaatgtgcaaaatggccgactttgcctggtacttcgggcgtgccatctggtcatttagcgtagggaccggctgcggtgattcgcgtttcgcatagcgggcggcgtttttaccaatctgacggtaggtttccagcgtcagcagcggcgcctgcgggaacagctccaggttggagagcggcggtagcccctgctggtggataaccgtagtatctttcgactggatgccgatggagatgccggagccgctcaggcggttaccttcaacggcgacgaacgccacgtcggaagatttaaagcagcgaatcacgcgcgccctgataccttcttcttcaataccggcaatgacttcgcgcaggatgctcttatgcggtaagccgacgatattaacagtctgtgccaggccaaatgccgggccgacggcgataatgacttcgtcctgctgagtgccctggcgtgcttcgcccacttcggtcagaaagccgtcgcccgcaggcgcagcggtctgtggtgctgtggatgccgcaggcgtattaaacgagacgggtttatcgctgcccttcatatcgcggagcacgtcttcaattatctggcgcagcaatttttcattaatttccatttctcaccccttaatcaatctcgttgggatcaagagcgccagggatgtttttaatctcttcccagcgttctccctgcaggcgataacctgttgccggaccggcatagtcattgacgtcattaaccgcagagagcacttgtccgtcgccgacgataatggcggaggtgtgcaaatagtcgccggttagcttggctttctggatgttgagcatgtcctgggccacgtcggtaaacccgccctgcgccagcgctttaacgacttccagaccgttgcggtttttattgatgatttcctgggcgaacttgatgtcttcgacgatgttacgctccggcatatctttcgaaccgtgggcataggtcgcggcttcaacttcttcatcggtaatcggcggcagccccattccggcaaacacggcctgcagcgcgcgggcggctttgttacggatggcgataacgtcctcttcacgaaccgggcgcagaccgccgtccactttcaggtcgcgctggataacgttgtagtcgtcaaagtcttccgcatcttcgttggaaccggcgaacatgttgtcgtagttcggcaccgcggaataaccagaggagataaagtcggtacccggcaggaactgcatcagcaggcgcgcggtacgacgcatatcggagtgggtgaaggtctggtcgttactggaggagcattccagatccagcgaagagcagatcaggttttccgccagcacggcacgaatgcctgacggcacggcagacggtacgccgatacagcttacggagccattttgcagaccctgaacgccagccgctttggtgatatagatgcagcgcgcctccagatacagcatggatttgccttcggcgtagcccatctgcacttcggatccggagccggaggtgaagcgcattttcaggccgcgagaggcgtaggaagaggctaagaagcctttcgaccatggcgtatcgtcaccgtcggtgaagaccggctcggtgccgtaaacggaaatggtttcggcgtagcaggtgtggcccagcatgccgagcttcagctcggtggcttcttccagggagcactgagtcagtacgcccggacgaccaacctgagagccgaccaacagcgcgatggcgttgaacggcgcgtagcgtgctaccgcaaccgtggtttcttgttcgtcaaacccgcgccatgcgccttcggcggcatcggcggcaatttgcaccgggttatccttgacgttggtgacgtgcgcctgctgagacggcgtgcggcgtgcgcgcattttctgcatcgccatcatcatctcaaccacgttcatatgcgaaaccacttcaacaattttcgccggggtcatggcggtggtcagcggaacgatttcgctgcgcttgacgttcggatcgcagagcatgttagccagcttgaccgaatccatcgccatcacttcttcggcgcggttcaggttgatgccgtagcgggcgataaagtggtcgatcaggtcgaattcgctaaccggttttccgtccagctcggtcaccgcgccgttaacgattttaatcgacggttttggatcgttcgggctttccatcgcgataaagccttcttcgatccactccttaacgaagccgtcctgattcacagggcgtttcgccagtgcttcaaatcttttcgatctcatgaatcagcctcgtgggtatcagatgtaggacgggcgatcgtttttcggttcagaaccgagggtcgcaaggacggttttgccgatttcgcgggcggaggtcaccgcctgacggaccgcgccggagtcgccggaaatcaccagaatggcttcgttactaaagctggtgccgtgcgccggagagctgtacgccacgacttcaacgttggctgacttcagggcggtatcggccatcagtacgccaacggaagccggagcgccgacgatgacgccgcaggcacggccaatcggcgcgccgaacgttttttccagggcgtagctggcgcgagcggtgtactgcagctcgatatgcccggcttcgttgccgtaaacatcgccgaaggtgcggtccagctctttcagcgcgacttcgataccgcgcttgacgtcggaaacgtcgttaccgcctaaaataatcagcgaaccgtggcccgcgccgcctttggtatcgcgcggcagctcaatgctgaccacttcggtgttggtggctttcaccgcttcgtccgccgccataatgtgcgggcctgcgccggtgcgggcgccgagaatgccgatggaacgatagcgcttctcaagtttcatcgcgtccagcagggcggtatcgacgttggcgataaccaggccaagggtatcgccaatggcggtcccgacaaattccgttaaactgcagcttttttctgccatagccgtctctcgtataggttggggttgaccagggatggcctgttgttccggcgttgccacacgggcaatcacctgcgccatgatctgttccaccagctcattgctgctcattggctaattcccttcggtaagattttttctacatcggtgtgagggcgtgggatgacgtgtacggctttcacttcacccacgttgcgtgcggctgcggcacctgcatcggtggccgctttgaccgcgccaacatcgccgcgcacgatgacggttaccagcccggagccaatcttttcatagcccactaacatcacattggctgacttaaccattgcatcagcggcctctatgactgcggttaagcctttggtttctaccattcctagtgcttcttgttgcataaagacctcgcatggagtgttccgatagttgggactataagaagatgcgaggaaaaagaatggctgacttgctgttgagcatcagaaaataatgggaaagcaatatgactaaattgtcttttgcttttataacttattgataaattacatttaatttattattgtctatatgattattttgtttttattatttcatttttacatttttgttagtgacgagagtatttttatttgatatggcgaaagacgcaaaatgtgatgcttattcgaaattgataagttggcttgtgcaatattttattattttcacaggcgtattttatagctcgaatctcccgtatgataggctgctaaaaatatcggaaaagcaaaattttgctatcgcaacacgatttttccgggagacaggttcgcaggttgccaacaatttacaggcggcactttttatagtgaggttagctgtactctaccgccagccgaaacttgcgctggccaggacacgaactttgctcagaaggtgtcacatgaatgattctctaaaggcgcaatgtggtgcggaatttttaggcaccggactctttttgttttttggtatcggttgtttgagcgcgctcaaagtcgcaggcgccagcctcggattatgggagatttgcattatttgggggcttggaatttcactggccgtttaccttactgccggaatctccggcggacatcttaaccctgcggtgacgattgcgctgtggctgtttgcctgcttccccaaacagaaagtattgccttatattattgcccagtttgccggcgcttttggcggcgatctgctggcgtatgtgctttatagtagcctttttactgaatttgagactgcgcatcatatggtgcgcggtagcgtcgaaagtttgcaattagccagcattttcagtacctatccggccgcagcgctaaatgtatggcaggctgcgttggtggaagtggtcattacgtcgatcctgatgggcatgatcatggcattgacggatgatggcaatggtattcctaaagggccgcttgcgcctttgcttattgggatactggttgccgttatcggcgcgtctactggaccccttaccggttttgcaatgaacccggcgcgtgattttggtcccaaactgttcacatggttagcggggtgggggaacatggcgatgagcggtgggcgagagatcccttattttatcgtgccgattgtcgcgcctgttatcggcgcctgtgctggagcagccatatatcgctattttattggtaagaatttaccttgtaaccgctgtaaactgtaagaaaatgcgaaccagattcacagcaatgatgtatcgtaaaaacaggtgagataatttcgtgatctgctttcacgaactgatcaaaacgtctcccagcaatgggagacttttgatattgtcattgtactttttatcagggccaggataatgctaataaaaagtgaatgtaaataatgtgttttgtttataacaataaattaactgaggggttttatcatgatttctgcgagcgctctgaactcagaactcattaataaaatcgcacaggattttgcacaagccaccaccggtctggcggttgtggttgtcaatattcatggtgatgaaatatctgagctattcaatttcacgccgttttgtcagttgatgcggcagcatccccagcatagtacacgttgtcgtatgagcgatcgctgcgggggactggaggcatcgaagtccgatcaaccctgtatttatcgttgtcatgccggtctaacggatttttctattccgctggtaatcgcagggcatttagttggctttgttttatgcgggcaggttcgtttaagtaatgacgtggagctggtaaacattcttaatgtcgacgatcgctggcaggctgaccctgagctcttgaatgaatttcggaatgtgccagagatggactattcacgcgttatcgcttccgccgatcttcttaaactgatagttgagaattgcctgaaaaaacagctcaatttcgtggttatcaaagacaatccgcagcaatcggaggcaaataaaaccactcgtggccccactccgcatgacagtaaaatgaaaaaagcgcttcgctatattgatgcgcatttgtccgacgatcttcgtcttgaggatgtcgcctcacatgtctatctcagcccctattacttcagtaagctattcaagaaatatcagggaatcggatttaatgcgtgggtgaaccgccagagaatggttagcgccagagaattgctttgccatagtgactggagtattgccagtattgcgcgtaatttaggcttttcgcaaaccagttatttttgcaaagtcttccgccagacctatcaggttacgccgcaggcttatcgtcagcagataaatgagaattctcatcctccatcgatataaatagcaatattttgctattgccgatttttgatagtgttttgtatcttaatcatttcagaaagaaaatttatctggtgtaacaataaattgtcatagcgcaacaaaataataaaatttagggcataaactgcaccagtttttatttttgtgatgaagtacagtgtcaggaaagataagttttattacgctttgtcgatacgttttatcgtcaatataccggtaaggatgagtagattaacgtcagatgagcaaccgctcaggctattgctcacagaaatgtaaaacgtagcacattattaattgccgttatgggtgtgccgtacagccataacgtaaaccaacaggtttgccacatttgtggtagggaagggggtgaaaatcccccgcagcccccgctgctgtgatgctgacgaccccgtaaagaccactgatcgcaagattgggaaggacgggcgaggaggacgctaagccagaagacctgcctgtcggtgataaccaacaacttcggtgggaagtgggttgcgaagacgcgtacagtcgaaagactgaacatgcgcgtacctgtatacccctaccaccctgaacaggatcagggtaatggcggcaaggcatcacgctttattcttgcaggcacaggaagcggttgcggcaaaaccacggtgacgcttggtttgttgaggctgctgcaaaaacgcgcgctgcgcgtacagccgtttaaagttgggccagattaccttgataccggctggcataccgctatctgtggcgtggcgtcccgtaatcttgacagtttcatgcttcctcctcctgttctcaacgccttattttgcgaacaaatgcggcaggcggatatcgctgtcattgaaggcgtcatggggctgtatgacggctatggcgtcgaccccaattactgcagcacagccgcgatggccaaacagcttggttgcccggtcatcctactggtggacggcaaggctgtttcaacgtcgcttgcggctatcgttatgggatttcagcacttcgacccgaccctcaacctcgcgggcgtgattgtgaatcgcgtcactagcgacgcccactatcagctcctcaaaaatgccattgaacattattgctcactgccggtactggggtatgtccctccttgcgacggcgtcgcattacctgaacgccacctggggttgattaccgccagagaatccctcgtcaatcagcaatcatggcatgattttgccgccacgctggaacaaacagtggatgtggatgcgctactctcgctgagcctgttatcagcgcttccggcgggaatgtggcctgaacgccccgataacacagcgggggcagggctgacgcttgctctggcggatgatgaggcctttaacttttattaccccgataacatcgatttgctggagcgtgccggcgttaacattgtgcgttttagcccactgcatgaccgcgcattgcctgattgtcagatgatctggctgggcggtggatatcctgaattatacgccgcggatctggcggcaaatacggcgatgttaaaacatttgcgggcggcgcatcagcgcggcgtggcgatttacgcggagtgtggcggtctgatgtatctggggagcactctggaggatagcggcggggaaattcatcagatggcgaatattatccccggtcacagcaaaatgggtaagcgacttacccgctttggttactgtgaggcgcaggctatgcagccaacgctattggcggtgcctggcgagatagtgcgcggccatgaatttcactactcagattttatccccgaaacacccgccgttatggcctgtcgtaaggttcgcgatggccgcgtgttacaagaatggactggcggctggcagacaggcaacacgtttgccagctatctgcacgtccatttcgcccagcgtccggaaatgttgcagcactggctggcggcggcgaggcgagtattatgacgatccttgcctggtgtatcgcctgggtgctggattttatcatcggcgaccctcaacactggccccatccggtacgctggataggccgattaattacgtttgtgcagcgtattgtgcgtcgctattgtcccggcgataaagcgctgcggattggcggcggcgtaatgtgggttgtggttgtcggggtgacctggggcgtggcatggggcgtactggcgctggcgcagcggattcacccctggtttggctggagcgtcgaagtctggatgatctttaccacgctggccggacgctctctggcccgcgccgcgcaggaggttgaacgaccgttgcgggagaacgaccttgcggaaagccgaataaaactctcctggatcgtcgggcgcgatacgtcgcaacttcagccagcgcagatctatcgcgccgtggtggaaacggttgcagaaaacaccgttgacggcattatcgcgccgctctttttcctctttctcggcggcgcgccgctggcgatggcctacaaagccgtcaataccctggattcaatggtgggctacaaacatgaaaaataccgggcgattggtatggtcagcgcccgtatggacgacgtagcgaactatttgcccgcccgactgagctggctgttgctgggcattgcggcaggactgtgtcgcctgagtggttggcgggcgctgcgtattggctggcgtgaccgttataaccacagtagcccaaattgcgcctggtcggaagcgtgtgtggctggcgccttaggaatccagctcggtggcccaaataactactttggcgagcgtgtggacaagccctggatcggcgacgcgcagcgcggtatttccgtggacgatatttcccgaacgattcgattgatgtgggtcgcttcaaccctggcgctggcgctgtttattgcggcgcggtgcgggttatctggcgtggcctgaggacgacagtatgcattatatccagcagccccaaaccattgaggccaacagtttcaccattattagcgacattattcgcgaaacgcgtcctgattaccgtttcgccagtccgctccatgaggccattatcaagcgggttattcataccaccgccgatttcgactggctggacattttgtggttctctgccgatgcgctggagcagctttgtgatgcgctacgccaaccgtgcattatttataccgataccacgatggcgctgtccggcattaataaaagattactggcgacgtttggcggcgagtgtcgctgttatatcagcgatccgcgcgtggtgggcgtaccggtaggctttgtcggcgcggcggagtccaaagaggcgctcacccatagccattttcccgcggttgccgcgttagggcgtaaaggcggcagtaacgtggctgccgctatcgtcaatgcgctgctctatcacctccgggaggcctgatgagcgagctttcttttgacgcgccggtctggcgccacggtaaagcgttacgtaaaggatataccaccggttcctgcgcgacggcggcggcaaaagtcgccgagctgatggtattacgtcaacatctgattcatcaggtctccatcgtcacgccgtcgggcgtcacgctatgcctgaacgtggagtcgccgcacattgaaggccagcaggcgatagccgcaattcgtaaagatggcggcgatgacgtggatgccacgcacgggatgctgatttttgcccgcgttacgctcaacgacagcggtgagattacgctcactggcggcgaaggtattggtacggtaacgcgtaaaggggttggactgccgctcgggagcgctgccatcaatcgtacgccgcgccataccattgaatctgcggtgcgcgaagcgataggcccggcgcgtggggctgatgtggagatttttgccccggaaggcgaagtgcgggcgcagaaaacctataactcgcggcttggcattcttggcggcatttccattattggcactaccggtattgtgacgccgatgtcggaagaaagctggaaacgctcgctatcgctggaactggagatcaaacgggcgtcaggattaacgcgggtgatactcgtgccgggcaaccacggcgaacggtttgttcgcgaacaaatgggcgtcgacacacaggcggtcgtcaccatgagcaattttgtcggctacatgattgaagaggcggtacggctgggattttgccagatagtgctggtgggtcatcctggaaaattgatcaaaatcgccgccgggatctttcatacccatagccatatcgccgatgcgcgcatggaaacgctggtcgcgcatttagctttactgggcgcgccgctggagttactcaccctggtcggcgattgcgataccactgaagcggcaatggagcacattgaagcatatggcttcgggcatatctataaccatcttgccaggcgtatttgtttgcgagtcatgcagatgctgcgttttaccaaaacgccgcctgtctgcgacgccatcctgttttcttttgataaccatattctcggcagtaatcgtcccgtcgacgagattgctaaggagctgcaatgctaacggtcgtgggaatggggcccgctggacggcatttgatgacgcctgcggcgctggaagcgatagaccacgccgatgcgctggcaggcggtaaacggcatttggcgcagtttccggcgtttggcggcgaacgatttacgctgggcgcggatattggcgcgttgttgtcatggattgccgcccgtcgggataaagggatcgtggtgctggcctccggcgatccgctgttttatggcatcggtacacgcctggtggcgcattttggtatcgaacaggttcgcattatccctggcatcagcgccgtacagtatctgtgcgcacaggctggaattgatatgaatgacatgtggttgaccagtagccacggtcgttgcgtcagcttcgagcagttggcgaaccatcgcaaagtggcgatggtcacggatgcccgctgcgggccgcgggaaatcgcgcgggaactggtcgcgcgtggtaaagggcatcgcttgatggtgattggtgaaaatctggcgatggaaaatgagcggatccactggctacccgtcagtgcggtcaacgccgactatgaaatgaatgcagtggtgatcctggatgaaagatgagctttttctgcgcggcgagaacgtgccaatgaccaaagaggcggtacgggcgctggcactgtcgaaacttgagctccaccgcgccagtcacctgattgacgtcggggcgggaacgggaagcgtctcaattgaagcggcgctgcaatttccttcgttgcaggtgacggctattgagcgtaatcctgccgcgctacggctgcttgatgagaatcgtcagcgctttgcctgcggcaatatcgatattctccccggcgaagcgccaatgaccataaccgggaaagccgatgcggtgtttatgggcggcagcggcgggcatctgacggcgctgattgactgggcgatgggccatctgcatcccggtggccgtctggtgatgacctttatcttgcaggaaaacctccatagcgcgctggcgcatcttgtgcacatcggcgcatgccgaatggactgtgtacagcttcagctttcatcgttaacgccgctgggggcgggacactatttcaaaccgaacaaccctgtttttgttatagcctgtcagaaggaagaaaaccatgtcagagacatttgatccacgctgtgtatggttcgtcggcgccgggccgggcgatcgcgagctgatcacgcttaaaggctaccgcctgctgcaacaggcgcaggtagttatctatgccggttcgctgatcaataccgaactgctggattactgccccgcgcaggcagaacgctacgacagcgccgaactgcatcttgagcagattatcgagctgatggccgcgggcgtgaaagcgggaaaaacggtggtgcggttgcaaacgggcgatgtctcgctgtacggctccgtgcgtgagcaaggcgaagagttaacccgccgtggtatcgactggcaggtagtgcctggcgtcagcgcgtttctcggcgctgcggcggagctgggtgtggaatataccgtaccggaggtatcgcagagtctcattattacccgtctggaagggcgtacgccagtaccggcgcgcgaacaactggaggcgttcgccagtcaccagacgtcgatggcgatttatctctccgttcagcgtattcatcgggtggcggaacgtctcattgccggcggttatccggcaactacgcctgtcgcagtcatctataaggctacctggccggaaagccagaccgttcgcggcacgttagcggatattagcgacaaagtacgtgatgctggcatccgtaagacggcgctaatcctggtcgggaattttctgggtaaggagtatcactactcaagactttatgcagcggactttagccatgaataccgtaaagcctgaatccattgcgttgttttgcctgacgcccggcggcgtggcgctggcaaagagactcgccgcgatgctgccgttaacctgctttaccagtgaaaaactgcgggaagagggatttattcccttcgatggcggattcgctaataccgcccggcaggcttttaccacttataccgcgcttatttttatcggcgcgaccggcattgccgttcgtgtcctggcgccgttagtgaacgacaagttcagcgatccggcggtggtcgtcattgatgaacgtggtcagcatgtcattagcctgctttccggtcatgcgggcggggccaatgccttgacgcgctacctggcaggaatgttaggcgccgatccggtgattaccacggcaacggatgtcaatgagatgtccgcgttggacaccttagctttccagcttaacgcccgcatgtccgatcttcgaacggcggtaaaaaccgttaaccagatgttggtcagtcatcaacgtgtggggttatggtgggatgccgaactaacggaagagatcggccagtgtgatattcgcggttttatccctgttgatgatttgcagcggttgcctgaactggatgcgcttatctgcgtctctttgcgtaatgacctccctgagcttcccgtactgcactggaaactggtgccccagcgcgtggtggcgggaattggctgtcgccgcgatacgccatttcccctgttagcgacattactggcgcgtcagcttgaagcgcagaaactcgatccgctggcgttaaaagcgattggcagcgtcacgctcaaaaaaggggagccggggcttattcagctcgcctcctgctgccgcgtgccttttaaaacctttaccgccgaagcgttgcgcgaattcgaacaccattttcccggttctggcttcgtcagaaaaacggtgggcgttggcagcgtatccggcccggctgcgtggttattaagccagggtcaattgttaggcgaaaccctgcgcgaacagggcgtcactattactttgggagtttcacactgatgttaagcgtaatcggaattggccctggctcacaggcaatgatgacgatggaggcgattgaggcgcttcaggcggcggaaatcgtcgtgggctacaaaacctatacccatctggttaaagcattcaccggcgacaaacaggtgatcaagaccggcatgtgtaaggaaattgaacgctgccaggcggctattgaactggcgcaggccgggcataacgtagcgctgattagcagcggcgacgccggtatttacggcatggcgggactggtgctggagctggtgagcaagcagaaactggacgtcgaggtgcggctcattcctggcatgaccgccagcatcgccgccgcctctttactgggcgcgccgctaatgcatgacttctgccatatcagcctcagcgacctgctgaccccgtggccggttattgaaaaacgcatcgttgccgccggagaggcagactttgttatctgtttttacaacccgcgcagccgcgggcgcgaagggcatctggcgcgcgcgtttgacctgcttgccgccagtaaaagcgcgcaaacgccggttggcgtggtgaaatccgccggacgtaagaaagaggaaaaatggctgaccacgctcggcgatatggattttgaaccggtagatatgaccagtctggtcatcgttggtaataaaacgacctatgttcaggatgggctgatgataacgccgcgaggttacacgctgtgaatgagggggaggtgctggtggtgggcggcaccagcgatgcgcgcgcgttatgccgacaactgggtgcggcgaacgtcgcgtacaccttatctgtggcgacgccagccggaaaagcgctggctggcgacattaaaggacaggtgcgctgtggtcgtctggagtacgggcagatggtcgcatggctaaaagaaaaccgtactcgctgggtaatagatgcgtcgcatccttatgcagaaatggtcagccataacctccttcgcgcctgtgaaacggcggacgtgttgttaagtcgttatcagcgtccggagcagcttagcaatctgacgcatccgcttctctatacggcgcgcagtattgccgatgcctgcgagatagcgaggcgttttggtccgcgcgtgttactgacgaccggcagtaaagatctggccgtctggcgtgccgggctggcggaaaaaacgttgctggcgcgcgtactgcccgtggcggaggtgattcaacgctgcagcgaactggggttcggcgttggagaaattttcgcactgtgtgggccgttcagcgctgattttaacgccgcgttttaccgccagtgccgggctgacgtggtcattaccaaagcgtccggcgcggagggggatatcaggaaaaagttcagccctgtctggatgcgggcattccctgcatcgttattgcgcgcccgacgccgctcgtgacgggtgatgagttactggaaagctaggccgcctttgcgcagcgtttatcgcgctggctggccgcagctaaggagtaaaaatgaaaaaagcgcttctggtggtcagttttggcaccagctatcacgacacctgtgaaaaaacattgtggcgtgcgaacgtgatctggcggagtcctgtcccgatcgcgacctgtttcgcgccttcacttccggaatgatcattcgcaagcttcgccagcgtgacggtatcgacatcgatacgccattacaggctttgcaaaagcttgcagcacagggatatcaggacgtggcgattcagtcgttgcacattattaacggcgacgaatatgaaaaaattgtccgtgaagtacaaatcttgcgtccgttatttactcgcctgacgctgggcgtgccgctgctgagcagccataacgattatgtgcagctaatgcaggcgttgcgacaacagatgccatcgctcagacaaacggagaaagtcgtttttatgggccacggcgccagccatcatgcattcgcagcttatgcctgcctcgatcatatgatgaccgcgcagcgcttcccggcgcgcgtcggcgctgtagaaagctacccggaggtcgacatcctgatcgacagcctgcgtgacgaaggcgtcaccggcatacatttgatgccattaatgctggtggcgggcgatcacgccataaatgatatggcttcagacgacggcgactcatggaaaatgcgctttaacgcggcgggcattccggcgacgccgtggctgagcgggctgggagaaaacccggctatccgggcgatgtttgtcgcgcatttgcaccaggcgctgaacatggcggtagaggaggcggcatgaacggtaaattatacgcattaagtaccgggccaggcgcgcccgacctgataaccgtccgcgcagcgcggattcttggctcgctggacattctgtatgcgcccgccggtcgtaaggggggcgatagtctggcgttgtcgattgtgcgcgactatctcggcgagcagacggaagtacgttgttgccatttccctatgagcgctgacggcgccgagaaagaagcggtctggaacgaggttgccgccgcgcttaccgcagaggtggaagcgggtaaacaggtcggttttattaccctgggcgatgcgatgctattcagtacctggatttttttactccagagaatcggctgcccggagtggctggagattgtccccggcgtcacgtccttcgccgcgatagccgcccgcgcgaaaatgccgctcgccatagaacggcaatcgctggcggttatttcttgtaccgcgccggaagcggaaatagcccaggcgctacaacagcatgatagcctggtgttgatgaaagtgtatggccgattcgcccgtattaaagcgttgctggcgcaggctggcctgctggaatgcgccttaatgatgtccgaggccacgctgcccggcgagcagtgctggcgccacctccacgaggtcaacgatgatcgagcgttgccctatttttcgaccattctggtcaataaacagtgggagtatgcagaatgaaacttgaacagcagcttagacagttgtctttcagtggactggctgcagcgctattgctgatggttgtcccgcaacaggcgtttgcgatgcatatcatggagggctttttaccgccagtgtgggcgctggcctggtggttactgtttttaccctgcttgtggtatgggctggtacgcttacggcgtattgtgcaggaggataatcatcagaaggtactgctggcgctgtgcggcgcgtttatttttgtcctgtcccgctcaaaattccgtcggtaacggggagttgttcacatccgaccggcgttggtctggcggttatcttgttcgggcctggggtggtggcgattctcggcgcggttgtgctgttgtttcaggcgctattgctggcgcacggcggcctgacgacgcttggcgcaaacggaatgtcgatggcggtgattggcccggttgtcggttatctggtgtggaaaatggcctgccgtgccggactgcgccgcgatgtcgccgtttttctgtgcgcgatgctggcggatttggcaacctattttgtgacttcagtccagcttggcgttgcgtttcccgatccccatgccggagcgacagggtctgttgtgaagtttatggggattttctgcctcacacagattcctgtcgctattgctgaaggtttattaaccgtcatgatttatgaccagttaaccaaacggcaagtgattaccgtacaaggacattaaaatgaaaaaaacgttgatgttgttagcgatggtggtggcgctggtgattctgccgttttttattaaccatggcggtgaatatggcggttcagacggcgaagcggaaagccagattcaggctcttgcgccgcagtataaaccttggtttcagccgttatatgaacccgccagcggtgaaattgaaagcctgctgtttacccttcagggctctcttggcgcggcggtgattttttatatcctggggtattgcaaaggtaaacaacgccgtgatgaccgggcttgatcgactcagctatcaaagccgctgggcacacgttgcgccgcagcgcaagtttttgctgtggctggcgatgatgatactggcgtttgttctgccgcctgtagggcagggcattgagctgctgatcattgccggattgagctgttggctattgcgcatatccctctggcgttggtgtcgatggatggcgataccttttggatttttgttggtcggcgtgataacgattatcttcagcatcagccgcgagccgcaaatgctgctggctggcatatctgttgggccgtactggatcgggattacccgtgcgggcgtggttacggcgaatgaaacgttctggcgtagcctgacggcgctgtccgcgacgttgtggctggtgatgaacctaccgtttccgcagttaattagcttgcttaagcgcgcgcatattccacgcctgcttaccgagcaaatcctgttaacgtggcgctttctctttattcttctggatgaggcggtggcaatccgtcgtgcgcaaacgctgcgttttggttattgcagcctgccgaacggctatcgatctctggcaatgctgactggactcctgtttacgcgggtgttaatgcgttatcagcaaatgaccaccacgctggatatcaaactgtatcagggtgattttcacctgtaaggactattatgcttgccacttcagacctgtggtttcgttatcaggatgagccggtacttaaagggttaaatctggatttttcgctctcgcctgttaccggtttggtgggcgcgaacggttgtgggaagtctacgctttttatgaacctgagcggcctgttgcgtccgcaaaaaggggccgtattgtggcagggaaaaccgttggattacagcaagcgcggactactggcgctgcgccagcaagttgcgacggtttttcaggaccctgaacagcagattttttatactgatatcgatagcgacattgcgtttagtttacgtaatttgggtgtgccggaggcggaaatcacgcgccgcgtcgacgaggcgctaacgctggttgacgcccaacattttcgccatcagcccattcagtgtttgagtcatggacaaaaaaaacgtgtggctatcgccggagcgctggtgctacaggcgcgctatctattgctggatgaacccactgctggtcttgatcccgcagggcgcactcagatgattgctatcatcaggcggattgtggcgcagggaaatcatgtcattatctccagccatgatatcgatcttatttatgaaattagcgatgccgtatacgtgttacgccagggccagatcctgatgcatggcgcgcctggcgaggttttcgcgtgtacggaagcgatggaacacgcggggctaacccagccctggctggtcaaacttcatactcaactgggactgccgctgtgtaaaacagaaacggagttttttcatcgaatgcaaaagtgcgcattcagggaggcgtcatgacgcaggcagttatgttgcaggggacggcatccgacgtcggcaaaagtgtgctggtggccggtttatgccgcattttttatcaggatggtctgcgtaccgcgccgtttaaatcgcaaaatatggcgcttaattctggtattacgccggatggtaaagagatggggcgggcgcagatttttcaggcggaagccgcggggatcacgccagatgtgcgtatgaatccggtgctgctcaaaccgaccagcgatcgccaggcgcaggtcgtgctgatggggaaagtggcgaccaatatggatgcggtgagttaccatgactataaaccgcgtttgcgtgagcaaatccttgcggtctataacagcctggcgcaggaatatgacgttattgtgctggaaggcgccggaagcccggcggaaatcaatctgcgcgatcgcgatatcgtcaatatgggaatggcggaaatggcccagtgtccggttattctggtggcggatatcgaccggggcggcgtattcgccgctatttatggcacgctggcgctactgcacaaacaggagcgtgacagagtaaagggcgtcattatcaacaaattccgcggcgacgtggcgctactctattccggtatcgaacaaatcgaatcgcttaccggcgtcccggttctgggagtgatgccatggctggatgtggatctggaagatgaagatggcgtcgcgctgcaaaacgataaatatcgcggtaacgccccccgtgatatcactattgccattgtgcaactgccacatatttctaactttacggattttaacgctctggcggcgcagccggatgtgcgcatacgctatattcgccgcccggaagcgttgactgacgctgatctggtgatcctgccgggcagtaagaatacgctgagcgacctcgcctggctgcgcgaaagcgggatggcggatgcggtattgcagacacatcggcagggcgtgccggtgatgggaatttgcggtggctaccagatgctgggcgacactattgtggatgaggtggagtcggggctgggtacgcagccgggcctgggactgcttaatacgatcactcgctttgcacaggataaaaccacgacgcaggttaacgcgacaatgtcaggcgagctgcccggctggctggctgccgcggcggggctaccggtacgcggttatgaaatccacatgggggaaacggtgctgcaggaaggatgctgtacggccatgacgttacagaaaaatggatgctctgtggcggatggcgcggtcaccgccgacggactggcgtttggcacttaccttcacggtctgtttgacagcgatgcctttacccgtgcggtggtcaatgggttacgggcgcgaaaagggcttgcgccgtgggaaacgactttttgttatgcggagcataaagcgcggcaatttgatctgctggcggaagcgatgcggcaacatattgatattgataaaatttacaccatcatgcaacagcatcaggagccggtatgatgattctggtgacgggcggggcgcgtagtggtaaaagccgtcatgctgaagccttaattagcgatgcgccgcaggtactgtatatcgccacctcgcagattcttgatgacgagatggcggcgagaattcagcatcataaagatggcaggccggcacactggcggaccgcagaatgctggcggcatcttgatacgttgattaccgcggatcttgcccctgacgacgcgattttgctggaatgtattaccaccatggtgacgaatctgctgtttgcgctgggaggcgaaaacgatcccgaacagtgggattacgcggcgatggagcgcgccattgacgatgaaattcagattttaattgcagcctgccagcgctgcccggcgaaagtggtactggtgacaaatgaagtgggaatggggatcgtcccggaaaaccgcctggcgcgccattttcgtgatattgccggtcgggtcaaccaacgactggcggcagcggcggatgaggtctggctggtggtctcaggtattggagtcaaaattaaatgagtaagctgttttgggccatgctcgcttttattagccgcttgcccgtgccgtcacgctggtcgcagggactggatttcgagcagtattcgcgtgggatcgtgatgtttccctttatcgggttgattctgggggggattagcggcctgattttcatcctcctgcaaccctggtgcggtattccgctcgcggcgttgttctgtattttggcgctggcgctgctgaccggtggttttcacctggatgggctggccgatacctgcgatggcattttttccgcgcgccgccgcgagcgaatgctggagattatgcgcgatagtcgtctgggaacccatggcgggctggcgcttatttttgtgctactggcaaaaattctggtggtcagcgaactggcgttacgtggaacgccaatgttggcggcgctggcggcggcctgtgcggccggacgcggcagcgctgttttattgatgtaccgtcatcgctacgcccgtgaagaggggcttggcaatgtatttatcggtaaagtcagcggacggcaaacctgcattactctgggattggcggtaatcgtcgccacggtattactgcttggtatgcaaggcctggccacaatggtggtcacactcgcggcgattttcatccttggccagttgcttaaacgtacgcttggcggtcaaaccggcgatacgctgggcgcggcgatcgaacttggcgaactgatctttctgctggctctgttatgagccgattattacggacgagacatcttatgcagacactacacgctttattccgtgacattcctgcgccggacgccgaggcgatggcgcgtgcgcagcaacatattgacggcctgctcaaaccgccgggtagcttgggcagactggaaaccttagccgttcagctcgcgggaatgccgggtcttaacggtacgccgcaggtaggtgaaaaggcggtgctggtgatgtgcgccgaccatggcgtctgggatgaaggcgtagcggtttcgcccaaaatcgtgacggcgattcaggcggcgaatatgacgcagggaacaaccggcgtatgtgtgcttgccgctcaggctggtgcaaaggtgcatgtcattgatgtcggtattgatgccgaacctattccgggcgtagttgatatgcgcgtcgcgcgcggctgcggaaatattgccgttggcccggcgatgagtcgctctcaggctgaggcgcttttgctggaggtttcccgctatacctgcgacctggcgaaacgcggcgtgaccttatttggcgttggggagctgggaatggcgaacactacgccagccgccgcgatggtcagcgtttttacaggaagtgatgcaaaagaggtggtggggattggcgcgaatcttccgccttcccgcatcgataataaagtagacgtcgtgcggcgggcgattgcgattaatcagcccaatccgcgcgacggcattgatgtgttgtcgaaggtgggggggtttgatctggtcgggatgaccggcgtgatgcttggcgcggcaaggtgtggcttacccgtattgctggatggctttctttcctactcggcagcgctggcggcctgtcagattgcgcctgcggtgagaccttatctgatcccgtcgcacttttcggcggaaaagggcgcccgcatcgcgctcgcgcatttgtctatggaaccctatttgcatatggcgatgcggttaggtgaaggaagcggcgcggcgctggcgatgccgatcgtggaagccgcgtgcgccatgttccacaatatgggggaattggcggccagtaatattgtcctgccggaggggaacgcaaacgcaacataacccgggcgcacaacaccagccatgtgagaaaaaagctatacttaacgcacacctgccgcgacaaaggaagggatataatgcgtcgtatcacacctttttttccgtttttcgtcttgttggtaagccatttctcgctggctataagctatccgttgccgcccgaaggcagtcgtctggtaggacagcctgtcacaatcgccgtacctcagaacaatactcagcccttagagtcatttgccgcccgctatggtcaggggttgagtaatatgcttgaagcgaatcccggcgtggatgtgtttttacctcagtctggttccacactggtagtgccgcagcagttgattctgcctgacaccgttcgtgaaggtattgtggtaaacgtcgccgagatgcgcctttattattatcccgcaggcacgaatacggttgaggtactacccattggtattggtcaggctggccgtgaaacgccgcgcaactgggtaactgcggttgaacgcaaacaagatggcccggtttgggtgccaacggctaatacgcgtcgggaatatgctaaagagggaaaaacgctgcccgcgatggtgcctgcggggccggataaccctatggggctatacgcaatatatatcggcaggttatatgccacccatggcactaacgctaactttggcattggccttcgcgtcagtcagggctgtatccgtttacgcaatgacgatattaaatatttattcgaccatgttcctgtaggaacccgcgttcagattatcgacaggcccgttaaattttcggtagagccggatggcagtcgttggctggaggtacacgaaccgctttctcgcaaccgtgctgaatttgagtcagacaaaaaagttccattgcccgttacgccagtgctgcgcacgtttatcaaaggggatgacgttgatacttcgcgggttaatgaggtgctggagcgccgttccggaatgccggtcaacattagcgcaggcaggtctggcctttaaatatcctgccacattgctggttttcatgggctggaacatctgtattagtagtgagtgtcatggcaggggcttcattttctcaacgaaccgcgaggccgccgattaagcccccaaaaactatggatgccaaaaagcccggaaaaccttatcaggtcaaccgggtaaagataagttcttattttttaaacgtctccggactcgcagggatatcccgaaactaaaatctggctcctctgactggactcgaaccagtgacatacggattaacagtccgccgttctaccgactgaactacagaggaatcgtgtggggtcgtatattagcggcggaaaaatttttgtcaaaccccatttaaccccttacagattcgattgcgggttatctcatcactttgttgcatttgcagacattttttctgcaaaaagctttgcagccttacgatttctcgctcattattgaaatgtggtttcaactctcttctttaaggtccattttgaacgtctccactgccttacgccaggttgtcgtccgtacgccctggtatgccaaacgcaagagctacaaagtgttgttctggcgtgaaatcaccccacttgctatccccatttttctggaaaatacctgtgttttgctaatgggcgtgctcagtacttttctcgtcagttggttgggcaaggaagcaatggcgggcgtggggcttgccgacagttttaatatggtaattatggctttttttgcggctatcgatcttggtactacggtggtggtcgcctttagcctcggcaagcgcgataggcgacgggcaagggcggcggcgcgccagtcgctggtgattatgacgctatttgccgttgtgctggcagtggtcattcattatttcggcagtgaaattattaatattgtcgcaggcgaggcgacgccagaagtaaaggggctggcgttaacgtaccttgaactgacggtactgagttatccggctgcggcaattgcgctaatcggtagcggcgcgctgcgtggggcagggaatacgaaaatcccgttgatgattaacggcgggatgaacattctcaatattgtcatcagcagcatcctgatttacggggctttctcctggcaagggctgggttttgccggtgcggggctgggattaaccatttcgcgctacatcggcgcggtagcgattatttgggtgctgatgattggttttaatccggcgctgcgcattccgctgaaaagctatctgaagccgttgaatttcggcattatctgggaagtgatgggtatcggtattccggcgagcattgaatcagtgctgttcaacggtggcaagctactgacgcaaatgtttgtcgccggaatgggcactaacgttattgcgggtaactttattgccttttccgtggcggcgcttatcaatctgccgggtaacgcccttggttcggcgtcgactattatcaccggtaagcgtcttggtaccgggcaaattggtcaggcagagcgtcaattgcgccatgtattctggatgtcgactatcgtacttacggcaatcgcctggggaacagcgccgttcgcgggtctgtttgcctcattttatacccaggagcaggacgtaaaagaggtagtgaaagttctgctctggcttaatgctgcctttatgccaatttgggctgccgcgtgggtgctgccgtcgggttttaaaggcgcgcgcgatgtgcgatttgcgatgtgggtatcgatgctggggatgtggggctgtcgcgttgtggcagggtatacgcttggtattgtgctgggtatgggggttgtaggggtttggctggggatgtttcttgactgggccgtgcgtggcgcactgttttactggcgtctgataagcgggcgctggctgtggagatacccgcgcgtaaagagggagtaagagctttttgctgtgaaaatcatcaggaaacggtgaattttaaccgaagtgtggaataaagcagcaaacgaactttttttgtgaaaacaggctttgacaagccaggggcacctcgttaatattcgccccgttcacacgattcctctgtagttcagtcggtagaacggcggactgttaatccgtatgtcactggttcgagtccagtcagaggagccagattttagtttcgggacatcctggcgagtccggagacgtttaaaaaataagaacttatctttacccggttggcctgagaaggtctgccgggttttttgacatccatagtttttgggggcttaatcgggggcctcgcggttcgctgagaaaatggagcccccacctatggcattaaccgataccgctatccgcaagattaaacccgtatcagtatgctgacatatagaggtgttcgattcaaacggagcgatcacacaagcttgccaggtgatgcccctggtgggaatcgcgactgtctctttcatctgatttcagatatttcccgtgatcttgatccgttctttcccaaaagattgatttctttcattcgaaacaaggatgtacaataagtaaaccaaaatagtaactatagagtttctaatggatacagtagaagaactaaatggaacatacttctatgcaggaaaatccaatctgactgctgccgaacttctgttatgattttctgtgagaataccgcaagccagtttgggattggtgttgcagatttcggggctgttgttgctctggtatcaggtcgtaataatctttggacaagggcgaaacccgctggagcgactaaaggcacatcatacgcgtccaggactgcacgtgcagtgtttaaaaagtcaaaatttccctttggaatatcccttccgacatggttaggcggttacaccccgtggacagccagacgtgttatggttcgtaacattgcgccgtttgttggacgttccattcctttgatcggggaaattatccttgccgcagatgtgtcacaaatagcatatcgcactatacgcgactacaataccattgctcggggcaatgataagttatgctagacaatattgaacagcaagtttacgagcttgtacggccttatgctggcacatatctgttcaacattaagcaagtggaattaacaccagagattgaccttgatactgatctgagcattgatgaacttgaagccgaagatctcatgaataaattcttcgagaaactcaatgtcgagcgaggtaacttcagaatagaaacctattttcctaatcaccctttttcatggcatccgttcaagaaaacggagcctgtacccgtcccagatttcactatcagcatgctgatcgagtcagcaaaagccgggaaatggttatatgactaattgtaatgaacttaacaaatggctgtaccagtacccttctttttgagcgatgatggtggcgctaagatagttctcttttctttttaaagggttcatgtttactgccgccgcccttacgctaacccctttagtttcctcctttgctgtcatactatcgaatgacgtgcctcacctgtgaacgctaaggagaataatatggaaaataaaggcacaaacctgacacccgagcaggcgctggatcgcctggaggagctgtacgagcagtcggttaacgcgctccgtgaagccatcgctgactatgttgataacggcacgctgcccgatccccatgccaggcttaacggactgtttgtttatccttcgctgtctgtaagctgggatggcgcgacaccgaacccgcctaaaacacgcgcttttggacgctttactcatcccggctgttataccactaccgttacgcggcctgcgctatttcgcgcttatcttctggaacagcttaacctcgtttaccatgattatggcgcgcatattgcgatagaggcctcgcaccatgagatcccgtatccttatgtgatcgatggctcggctctgacgctggatcgttctatgagcgccgggctaacgcgccattttcctaccacagaactggcgcagattggcgatgagacggcagacggtctgttccaccccggcgaattctatccgttatcgcacttcgacgcgcgtcgtgttgacttctcgttggcccggttacggcactataccggtacgccggttgaacattttcagcccttcgttttgtttaccaactacacccgctatgtcgatgagtttgtgcgctggggatgcagccaaattcttgatcctgacagtccctatatcgcgctttcctgtgccggcggaatttggatcacggcagaaacggaagcgccggaagaggctatttccgatctggcctggaagaagcatcagatgcctgcctggcacctggtaacggcagatgggcaggggattacgctggtaaatatcggtgtcggcccttcaaatgctaaaacgatttgcgaccatttggccgtgctgcggcctgacgtctggcttatgattgggcactgtggagggttacgagaaagtcaggcgattggtgattatgtgctggcccatgcctacttacgcgatgatcatgtgctggatgctgttctgccgcctgatattccgattccaagcattgcggaagtacagcgtgcgctgtacgacgctaccaaagcggttagcggaatgcccggcgaagaggtgaaacagcgactgcgcacgggaacggtcgtcaccacggatgaccgtaactgggagcttcgttattccgcatctgcgctgcgattcaaccttagccgtgcggtcgcgattgatatggagagcgcgacgattgcagcccagggctatcgcttccgcgtgccttacggcacgctgctttgtgtttctgacaaacctttacacggtgaaattaaactgcccgggcaggcaaaccggttttatgagggggctatttcagaacatttgcaaattggtattcgtgctattgatttactacgcgcagaaggtgatcgtttgcactcacgtaaattacgcacgtttaatgagccgccgtttcgctaacgaaatgggctgtcgcctgctgttgggcaggagcggaagaggcatatttatgtgatatggaaagtggttgaatgaagccttagcgggaggtgattctgcatcccgctaaggccttattgtgccgcggcttcatcaccatcgccggagatctgtcgccgataatcgcgtctacgtcaggaaacgcgccggaaggcgaaaacattgcgccgcacttcacgctccttgagcgcctggacccacaagcccggattaacaagcagataccgaccgtgagaatcgatcagcttaaagggattatcagaaggcttgatactgaggattttcgcgttggacagggatatagggtggtcacgccattatcgaactgaaatggccccaaatcagaccaccaatttcaccggatgcgcaggtaaaaccagatacgcatcggtaaaggttttcacgctaacttattgaaacctaattaaatagggacttataagtacgcctgaaaacagaaatttggctcctctgactggactcgaacttcatctacatctcctgttattactgcttttgttaaacttagccatatttttaccaacatatttaccatcattattgttttcttgtggttaaaatgtcaattaaaaacaattggttgttgccataatcatctgactatacgtatctaaatttgctttcattatcaacatgatgttgtcgttattttttttaaaataaatgatgaaaaacaattggttattttttattaaataaatcatgtttagtcaaggtgaaagcactgacctccaaggtcacttactgtgctcacaccattttgaaaacccgctcctcttttccactttctctatcatgttgaatgggctaacgtttaggaaacacaaaagcaatcggtagaacaatgactacacaaaaggaaatggaagaaatcagggcagcgttatcttggtttgatgtacgccgatatgatggccttaaagacctcaccttagaacaaatctatgcagagcttgaaagacggatgttggcttacaaaacaagacaacaatgggaaacagcaggcaaagataatcaaatgcaagcgatataccatgatgccacaatccgatgtggtgatgtgatacttaaatcagactggatttcagacaatcacagactgtcgcatagctatgctgtaagaccaatgaccagagttcaattgttcaactatgggcgggctatgtatcggctggagacttcagagcaaacagaccctgttgcagtgagttccgactacatctctgagtatctgaaacaaggaggcatgaaccctgctaacaagatgctgattgaaattgacttggaagaagccagcagtgacgatctcgcagaacatctgaaagtactgattgctctatggcaaaagcacctgaaaacgcctaaacccccgaaacgaaaatttaggtttggtcataagacctttgaaagaatacttgattacaaagtcatccctttgatggatttgatctcatgggaacagctctacaacgaaggtaagaacatacctttcaccattttagctgacatcctgcatggtaataatggggtcagaagtagtgagaacatcaaagatactgattatgattacgcgaaaagttatcttgataacgatgagtacttcaaggttttaaatgatttctatattaaaaacaatatgttgaaggattggggtatcgttgatgtgataacacttaacgataaatcctcggataaaaacaaaaagtaaacacaagggatgttcacaacctgcgaacatccctaaaaagcgtatccctccaaaaatttccgcgaaactcacggttggtgaacatccctagtttagaaccagccaaaatcctagaattatctccatcgaacaacatactaaaaaacgaaatatccaagatattacgtaaaaaaaacaggagataatatggttcaaaacaaaacagataaacatccgaaactgattcgtttgccagaagtaaaaagaagaacagggtttggtaaaacgtggatatataccttaataagagcgggtaaatttcctaagcaagtaaaaaccggattgcgctctatagcatttattgaaagtgagattgatgaatggatttacaaaatcatttctgattctcgcaatcatatctaaaaaagtttattaaataatgagaggttaagatgaaaagtaaaaacgtactgccttgtgtggtgactgttacgaatgatgagacagaagtatttatggaaatggcaataaataactttagaaaacatcttcaggtcatgattgattgtatgggaaatgattacgagcgtcattttaaagaccggctttatattgaagaagtgattggaaaagtgatcgagcgaacaaaacgagagtttgctgaatcaatgaaagataataaagggaaagaatatcatctgttcttggatgaggtgagaaggaatctgagagttatttattctgcgtatcgtactaactattaatgagagaggtgaatatgaacgaaaaatgtttaggctggaatgaaatacccgttaaaatatccgcaagtaatgctgagacagcaaactttgctactgatgttgtaaatacctataacgagttaatacattacttatactttaatctaagtgatgatgaatttctgaaaaaaatgaaggatggattttacagggagatattcataatggatattattaatctcacgctacaggaatggtttgaaagtgctgaagagataaagattaaatacatatcagttccagaggttaaaaccatactaagtagttatcatgagtttttgattaaatgctttaatggtgatgattatcttctttattacaaaagaatagaaatcagcgcaaataaacagactgtaatataaaataagaggtaatgaaatgagtgaaaaactgataaaagaatctcaaaaagtatttatgcatatggcaggtttgttttatgaaatcaaaatgaatacgcttaaggaagtccgacccgatgaagcagagatgttaatggaggatgatgcattcatggatagtatttataaggattgtatcaaaaatgcaagcgcatcttttaaaaaggtagtcagatgggagtactttgaacaagggcattcagtaaaaatggttgataaggaggtggtgttgataacattacgtgttaatcacaaacgaagataaaaaggttatttaataaatcatttttagcctcattcatggggcgaaaaaaaagaaaacaaatatcatttaatagtgaggcgtaaccatgagtaaaatttttgaaattaaaagtgtatctacagaaacgttttataatattgcagagcgttcgtttgaggctagttggaaggttatgcaggatatggcctctgataatgtctcatacttggtatatgatgcggattttatgtgtgttttcatcggcaatgttattgagcatatcagtaaaaatttttacatcattatccaatgtgaatgtctggaaggaaagcttgaagaagtaaactttgaagaggtagcggaacgtctggtccggcattcatgggagttttgtaaataatatcaaaataaaaatagattaagaaatcatgggcagagttgttatctactcactgatttagattatgtggccccgtaatggggctgtacatcgattacaagaggaatatgatatgaatgatgtggtattatacgaaaaaaatgaatcaatgttttttgccatttgcacggtcttatcattatattgcgatttcatatacgaaatagcatatggatttcataatgaagcggtaatgatcattgaaaatgaaaagtgtgtgggacaggcacttaaaatacaaataaacaatctattcgatgatttcgattactacaaaaaagtgaatggaacagaaaaagtaaaacgggaagatatagatgaaaaagaactctttaacaaagtaatggcagcacataaccaaggagtaaaagcgctaatcatgaagaatcttgaggccaatcttcgagagaaagaggaaggttctgaatattggaagttaaaaatatttaataggtttaatgggatatagaagtcaatgtaggcttctatatattcagataaagaaagtagtcatgatctttatctcatcggagaaagtgtttttcatggctggatatttaaaaaattattttattttgtttttcattattttttcgacttcttttttttgtgatgtagataaattccttttaatctctttcattttgtttttaaaattaagattatctctttcatcatgcaaggacttcattttattatatgcttcgtcactgaaaggatgtaagttatcatctattttttcatctaagtaagaagaaaggaagcatctatcaaaataattttttctaagcgcatcgtaaattttagcactatcaataattgtttcatcttccggttctttttttatatggtctgtcatgttgactcctcttatttttagtggattgtgtatatattttattttaagggattggttcaaagtgtcaaatttaaatgttctttcaaaataacgttcaatggtattttgaagctttcaatgctggattatataagaatgatttacatgtttatttgaaaaatagctatcaacttaagtaccgggattcgggactttaactcccggaagtcggtacttgttttttagctataactggcctgagagcatttttttcttcattattcagttagtgaagatgagaacaactaatcatagatgctttaggaggcagttttactttttattgcattggtttcctctcttgaatttatatctcagcttagtgattgttaggaataatcactaagcgctgctgctgaaaatatagttttattatacgtttaagatcaaatatcataggttgtaaataacatgctacatttcaagatgtgatcattatcaattatcataaggaaataatctataacgaaactagaaaatttaaatttaccatataagttatacgctaaaacgaaataattgattcagtattagggcatagccgtgtgtaagtagtagatggaattttcaggaagaatgttttaaaaatacatgctcatattattttagcagtataaatgaatgtgattattgtaaccatgatgaaataaaaaataataaccctattataaaaagaggttgactgtctacaaatcgaataatatcataataactatttatgttattatgatattagttaaaaatggaaagaatatgaataaaagacttaatatgctatatgtcaacaacattaacgcattaaataattaccgtgaaaaacattcagataataacttacatggccccctccttttaaagctaaaaaattattttcatcagcataataaattgatggttataggacaggaaacctatggatggtgcaactctcccgatattaatgaacagcttgaaacatatgaggagttcgattttggcgtatcatattatagcagtccattctggaatatcataaggaaagtagagcgagcgcttggtattgaaccatatgcaattgcatggtcaaatctgaatcggtttgatgttgattgcggatcaccagattataccgagctagctagagatatatcatcgtttgattatatattaaaggaggaaattaatattcttactcctgatatatgtgttttcttcacaaatcataaatatgattatcgactaacgtctttatatgaagatttaatgtttgaaaacataaatggattgccagaaaaacatttcgtaagattataccatccagacctcccagaatatacgattagagcgcctcaccctaaaacaatcagaataaaaggatgggaaaatgatttcataaaatatatagaggctattaaatgattatgcagatgcgatcttattaatatgaataaacaaaattgtgttactaattgcataacagcaatataagttattctatagtttatctaggccacggcgtgtaggtggccttaaacgaggagtatgatttttatcatttattgttgaaacagtcggtataaaatccatgttattatctgcattgactcgttcgtgcttaggacggcttgggaaacgtcgaatctcatcaggtgttggtttgtaagtatcactgttaaacttagcttgtttctcatattcagcacgagaaacatgatgacctaatacttcatcaaagacatagttttcagcaatacgtttatcatgttctgtactgacaggatcatgcttaactctgcttgatctaggccatacaaatttttctttgaagaaatctatgacaagagttgtgaaacgtttgaaaatattatcctgacgtggagtagtcttatcctttctttcatggtcaggggcgcttctggatgccctgtttgggttttgagaggtggatgttttcagaatagtatttgtaccagaatcagaaatactgattgatggcggaatacaagcaacaaccttactgacttttgttttatcacggtaagatttgactccacgcaaacgagtatcaggagctggtgctaccagtaaaggtctttgttcttcatttgtagaagagctggatcgcgtttctggtaaaacaatttcttctggttcagcaagatgtgtaatcgtaaagcttctgacatcaacgacgatttcaagatcaagttcgctgaatgttttgtagacttcaacggcttcttgcttggcagcatcacgaacagcctgttctgcggctctttgctcttgagcagctttactgcgccatttggcactatggatacgtttcattgcagggcggtttgtttcagcggctttagcaagccatagcgcttgttcttcattgtccagagcagccgccgctttttctaatgcctcttcatgctgggcctgaagggaacgatggtcaatacgttctgatgaacctgcggcttcgagatagctgttagccatagatgcccatgactcacgccacaacacagacatttttctgtcgttccagcttctttcttttttaccaaaaccttccgggcctatggcttttaacgtcaacataacgtgagcatgtgggttgtcgctatcaagatcatgaaaagcgatgtcggcaatcatgcctttatcaacgaaatttttctgacaatactcaaggacaagttttttcttgtcgtcattgtttaactcggtgggaatagcaacatcgaaataacgggatgtttgaccattgttctggcgctcaactttttccacttcattccacaatgctgtagagtcttttacgatgtgttctggtgcgttagctggagctaatatgaaatgcccgtacaaatcagtacggcgactataatcataggtatcacctgttctttcatctgttatccttgtacgagcatgataggcagccttcgcaacggaagacctgccttctgaacgtttcacaattttaaaatcaagatgaaaaatagccatacaataaaaacaacctcaatataagtttaaatatcaaactaaaatataactctccaatgcgactatgctggttttagtttttcgcaagaaaaactctggtgttgacgttgaccttgtttccgaaggaaacggtgttagcctgcggcaggcaaccgtcggtagaccccacacactgcgtagcagtgtataggtgggcattgctttatttttatatctcctaaaggagctaaaaataacgacaatgtataaagcttttctatagttaaataataacgctagttttaatgtctgtgaaattaacggggctagattcggatgaacggctgaggtattacacgaatcttaatgattatggttttagagagcgcccgtaagggcaaaagagttaatttccctcccgccgtaaggcgggaaaagccaaatgcactaaaacagacttataacgacagtttttttaaaaaaatggatggtgtaggttcggacttaaaataagagtgaaaaagcaaagggtgaaaaataaaccataaggaaagagagtcaagtaacgtggggaatattagatgatttaggttaatgattttgattgtatatgttgcatgattacatatagagcttgttgcatttttgtgcagagtcttgtaaacaccatttttgttatcaccttttgtatcataaccattttagttattgctgattaaacagtaaaaataaaataaaaatccatgagatcatatgttaaatgtgttttttgacgaaatatatttaagtttgtctggtcttttttatttttaataaagttaggttgttttatttgacaagtaaaatgttgtgttgtaaataaaataaagatacaaaaaaagccaactttcaaagttgactttttaaggactaaaaaagttttgccgacttttgaagccttgtaatcagttagaggaataacgtgattacaaatataataaagtattaaataatcttttcatatttgtcaaatctaaatctcaactttttacaagcctttcaaataccatttccaaaaacattttagtcttcaaaagcaataacgttaaacctgtgtatcaggtctaagaatctttggacatcatgtgttaaaaactgttttgttcttaggttattgtaggtggcatataaacggggggaagtcggtagccaccaacttgaagcgttcatctaaaatctataaagcggtagtataattttctttagtaaaacgagaaaatgctttaaatgatcatgatgtatccgtaggagtccgatggggtgtcccagtaatggaaaccgtgctggaactcaatagctacggtgagaatcgccaaccctgcgaacctaaaaaaaatattacaatagtatttttttacggggggttaggggggtgaagcttgcagaaaaactaagttttcctgacggaaaactactacgactgaaagtcgctatctaaaaccccagaacctaatctaataaaattctagtactactagtacaaaaaaataattttaaaaatatcagtaggtaggtgccatttcatcaaggcactaacgaaagataagtaggcttataaattaaatatggtgcatggattaatttgagttttttgttttttaattgtattaattaaaaaatataaataaaaaggtaatgatatggaaagtaaaacaaaaaaactaagaatgggatggatacaaaatcttactgagaatgaaaaaaagataatagatgattttctggaagaagccgctaagttaaaaggtaaagcactaaataaaaaagaaaaacaaactgtcaaatttattgctcgtgatcaagtccgctcgattagaaaagagcaaaaatcaaaaaaacaaaagaagagtagagttgatatggaagaaaaagaagatgaaacaattaataccatttcaaataatgcggatgagcaaggaagattaaagatactatcagctaaagaaagagattttatcaataatgccatatatgaagaaatgaaaattaaaggtagaaagcttgtaaaatgtgaaatgaaagaagttttaaaaattgctcgaaaaaagatcctcaacaatcgtatatcttgtcagatcaaaaatgaaagaaataaagaaaggtttgaggcagagtttgaatggagaaaaccagtgccatttcgtcgttaaagcattcattaatgatgatattataattttttataagaggtaatacatgaaaaaattgaaaacaaaaaaattgaaagaaagtgagtttataagatatatagaaaacaatcctgttgtctcaaaggctttatgcgaggaatatggaatctgtactgaaacaattgcctatgcattatatgttcatagcaataacttctttcttaaaaacgactacgttcaggatgacattcactatgatatagttaaaaacaatttaataataatgaaacccacgcttagacaatattatagaagaacaaggcaagtagattataacggatatacttttttatcaggtattaaagaatatcaagactattgtattttgttgacgctttgctgctatcattggatagctgatgtatttactgtctataatcatagtgaaagaagtcaatttatcgttgatgttgccaatgatcttctgaaaaggagtatagatcatttttcagtagagcatgagaatgttatcaactgctttaatatgttaaaagaaaagctcccatcgtataaaaagaaataataatccaatttttcaaatatcctcattgactaacatatatataagaaatatatatgtatcatggaactataagaggatagaaaatgagtgatatttcagataaagagcaaaccagaaagaaaccacgaataaaaaagacactggagcagcaattagcatctgctcagatgcgtttaaatcgtttgcaatataagtctaagaaagaagctaaacagatagaaacacgtcagaaaataattttaggggctgaagttgccaaggctcttgattgtgatgtttttacggtggataaggatcttgttttaggtatgctactagagatacctcacctacatccagatgataaagaaagatttaaaagaagcggaatgttatttctggcgagcatgaaaggaaggaaaacttgataatgcatataaactatttgacaagtattttaggaaaagttccaacagataattatcgttaactttcattaaaagatttgacattctatttatgatgatatatctatttatttaaaatctcataatcttatataatcagattctttcatctataaaatcataaaaatataattttaggtttatatatttcacgtcctgacaaatctctagcttaattttaatatggctggggatttgtttttatctgtatcttgatttttgtttgttatttgataattaattaatacgtgaatataaaaatggcgatgaaaatgaaaaaacaaaataaaaaagggttctcattacttgaactcattttggtgctgggtgtcggtagtatgatggcttttatgcgttttcaggatatgaaaactgaacaagaaaatgttatggctaaggctgttggtcaacagatgaagcagataggtgaggcggtaaatggctatatcaatatcagatatgacaagctttctacgctgacgtcaagcagtagtcagtcaagcgatccgggtccccgtacttgtaatggttcaggttgtgaaataacgtatcaaacattaatcaatgaaggattattaccaacagcttacactggtataaacgttaaaaaatctccatataaaatactattaaaacgtgatggaactgctcctaactatgttattaatggtcttataacgacatcgacggcatggattgaaggcggtaaaacacgttatgatttattagggaatgccatgcaaacagcaggtatagatagcggtatgactaaaacaacatctattgcttctgggtatagtggtcaatggacagaaacgtctgctaattttaataatatcacatccactggacaattagcatttagagttggttttaatagtgcgttatattctgtatatttaagacgggatggaaccttgcccatgactggcgatctaaatcttgacggacataatattaacaatatcgctaatatcaatgctacaggaaatattacgacgacaagcgacctacaggcaagaaatattaaagctacaggaaaagttgatgctgacggtgatatttcatcaggaagatatttgattgctaaaagcaaagatgaagatgcatcaataaaaattggaggcgatggcactggaaatcataattttatgtttgaatctcaaaaaagaacatctgttgttttttttccaagcgttaattctgcattgttaacttataaatttcgtgggaatataaacatattaagtccttctggggattcagttggtgttaaattaaatggcaccactggaaatatcactgcctctggaaacatagaggccgcccaaaatgtcaaaggcgctacattagaatccactggacgcgctacggtgggtgagtttgttcaattgaacggacaggctgaggttggaaaagtgtgtcaatctaatggattacaaggaagaacagcaaaagggaaaattttatcttgtgttaatggtgtatggaccggatcggttcaaataaataatagtcaatgtaaatggttttccccggctaatgctttttcatactttggagaatacagtgggcaacttcatgaaaaacctataatttgtccagcaggatatattatgacaggatctaaaatgtggggatgggcagaagatgttgatgacgaacatgttgatatctattgctgtcctttatcctaattaaaaaaggttaaaagttaaatcccatattcataaaagattttctgaggatgggattaccatagctactcttactcacggaagaaaaaaagctgaaatgtgtattttttatattttaattttgtgagttataaactggcctcctaaaaggccagtttatataatttaaaggttgctcattatttctgtaatggctgtggctcgaacatattttgctgcattagtcgcttaaattttaactgttgatgaaatgagaaattacccggttcttgaggataatcaggaaatatatttgtctaagaaaagtgaaaaaatttctgagccaccacctttcgggtgggttatcatgaaatgtaagtgagttattcatcatgatattgtaaggctagacaactatatcttaatattttgagtctggaatgtttttggtactaaatgtgtcgttaaagataataatcatttgacaaataatagcgattataataaggaatgttaaatagttacaaaggagataagatgaatatttttgacgataatgattacgaaaaagcctgtaaatggtataagcatatcagatctaatgttgaaggttttaatgttaaaatagaaaagttaagagaaaaaacagcattggatttattaaataatgaaggtgttgattattttcataaaggttatcaatcgtttgttgagcgctttgaaaaagtttttatcaaatcatttttggctccttatttaaaggggcctttttattcatctattggtatttattcttctatatatagttcttcttccatcttgatttttgtttgttatttgataattaattaatacgtgaatataaaaatggcgatgaaaatgaaaattaaaaaaggattctctttattagagttaactcttgttttaggtgttgggacgatggtggcttttatgaagtttcaggatatgaaaaatgaacaggagagtataatggcttctgctgtcggtcaacaaatgaaacagatcggtgaagcagttaatggctatataaatatccgttatgataaattatcaaccttatccaatgctgccggaacaggaaccgatccgggtccaagaacctgttcaggttcagtatgtgaaattacttaccagacattgattaacgaaggtttgctactttcaacctacacaggcactaatgctaataaatcctcgtataaaatcatattaaaacgagatggaacttcacctaactatgttattaatggtcttataacgacatcgacggcatggattgaaggcggaaaaacacgttatgatttattagggaaagccatgcaaacagcaggtatagatagcggtatgactaaaacaacatctattgcttctgggcatagtggtcaatggtcagaaacgtctgctaattttaataatattacatccgctggacagttagcatttagagttggttttaatagtgcgttatattctgtatatttaagacgggatggaaccttgcccatgactggcgatctaaatcttgacggacacaatatcaacaatgtcgccgcacttaatgccactggcaacattacgacgacaggtgacgtacaggcaagaaacattaaggctactggaaaaattgatgcggacggtaatatctcagccggtaattggatgtgggctaagaatggatatggggacgctataggttttggtggagatggatattctggaggtttaggtcgagattatgaaataaaaatgctatctaaccatccactaacgatacattcaccaacgtctagtcgcggaaatgatgttatattagatattgatggaaatatgagggttcagactgatattagctctcttagaaacattacagcctctggaaacatagaatcatcccaaaacgtcaaaggcgctacattagaatccacaggacgcgctacggtgggtgaatttgttcaattgaacggacaggctgaggttggcaaagaatgtcaatctaatggattacaaggaagaacagcagaagggaaaattttatcttgtgttaatggtgtatgggaaactatagatgctaatttaaaaatatcaacatacagtttaaagcctccaaaacatcaacttaatatgggagttcatagtgtatgctctttaagtaatgtaaaattttataaagggaataacactccatatattagctgtgaaataataaaaaatggaaataattggctttttcagacagtttattcaacacaatgtgaggctgtatgcataaactaaatcccataattactccgcgtcacgttcgattgaatggaaaaatcccagatcttttcttttttcttttaaaagactgacatggtaattttatattacatatggagtgttggttattctattatataacattaaaaagagtggatattaaaataaaaaagtgaagtatataattttataatctcaaactatagagaaataatctggaaattgtttcataaatattaaatcccatattcataaatattttcagagaatggggttaccatagctgctcctacttacggaagaaaaaatgctgaaatgtgtttttttagatttttattttgtgaattataaaatggcctcctaaaaggccattttatataatttaaaggctgctcattatttctgtaatggctgtggctcgaacatattttgctgcattgattttttctgcttttaaagcactaaaatgcgcagttccacaggctatcttcgcatcttcttcatgaccaagaccaatgtgtttactttttgtctctacaacaaagtaaatatgttcttcaccattgtcttcaataactaacgcccagtcaggattgtaggttcccagtggcgtcgggattttaaaccatcccggcagcttcacataaagcttaacttcatcctgttcttcgagttcctgagcgaaacggctttcgacttcagaatctttaggaacgtattcgtaaactgacttagacgaggtttcaaaaagattacgggcatatcctgttagctctttatccataaagagactttgcgcatacacctctccttttagtggataatatttaataccatcaacaattgacaggcgtttgcagtagttgattcggcctatagcttcactgataaactgctgtggatttttagcaaaatcagcgagtcttccactctctttcaggatggtgcttaaactgcgtcttgtcagtccggttttttcctgtagaacaccaagaatatctggcaatggctgctctgcaacatcaactacagagcttgttgttccattagacagagctttaacatcaaggccagattgactttgtttgattgttgctttgctgaaactgaccattgcttttgctacaggctgcatttcagaaagtgatttcgtacaggatttgatcaattcttcttcatcaaatgctagccgatacagcgttttttgacaaatgcgctgccataacgcttcgaattccgggctgtttaagacttctttccggtatttgattgttttacgttcatcagcattgtttatattgagtcgccctgctgatttacgcaggatagtttcaatttgttcctgtagtgaggcatacttctcactaacaacaaaagtgttttcgaataattcttttttcagggttttggtaatttttcccgatttttcaatataaccttcagtctgaagttcagaccagatatcatgtgaaccggaaatacctaaaccttgtgaggaatcagcgaagataagatgggcgaacgcatctttttcaatcacaccaaaacgtatgcctgtttcgctctcaatttcagactgtaatcgttcagcgtaggcttcataattttcactggcaacgactgtcagaatgttaatgctgtcatcacgaacacgttcaccctcttggttaacacacaggcgaagaccacggcctaatgtttgacgacgttctcgttcacttcccatctctcggaggctacagatctggaatacattggggttatcccagccttctttcaaagcagagtgcgaaaaaataaacctcactggattcgagaaactcaaaagcttctctttatttttcataatgagattataaccacgctcagcattttcacggcctgtattattgctttcgcttgtttcagcccatgcaccttttttatcaatggagaaataaccatcatgaacatctttggcatgttctggatgagaaggaagtaaatctttataggcagggcttttgattgctttaagatattcttcttcaaagatacgggcatattcacccggttcacgtactccttcttcattggtctgacgatataaatcaaccttatcaatgaaaaacagggtaagaaccttgatttgctgagtattcaggcgaagttctttatccagatgttcacggattgtacgtctgatcatatgacgctggatgagcatagggtcaatatcccccacgacatcaccgactttcatatagtaggtatcagaaggtgtttccagtgtaagataaccctctttgccagttcggatctcgcttatccggtaaccctgataaatatcacgtcctgtttcgtcatcgagtgtcataccgtcatatacggtaatctctgaacgatttacgttcccttttttatcggctatatcaacaataacagtcgcactaatgctattcttcttattgttaatactgaccagttttacataggggctattacttgcattttggacttcaagcccggcaacctcgatctgtttgaccagtttttggttgtaagcatcaatggcgtcaaggcggtacaccatatgatgtttatgaacatgtgttgctgaatagcgtaaggtgaacatggggtgcatagcatcaagtgcggttttacccgcaccgttcaagccaccatcaacactttgcggttcatcgacaataataattggacgtgtagcacggattaaatcaatgggcttatccagatcgtccacagttgttttttcactggactgatagagcttgttaacatcttttttgttaatcgcacccacagtcattaccatgatctgcataacagaactggttgcaaaatttcgaacatccgcaggttttgccgaatcatacagatagtattcgtatggaactcccgcaaacaggcttttaaaatgttcttcagttatttgtagtgttttataaacgccttccttgatagcaactgaaggaaccacaataataaatttactcatgccatagcgtttattcagctccagcatggtgcgaagataaacatacgttttacctgtccctgtttccatttcgacagtaaaatcatggctgtcgagcacaggtgaaggtggaagctggttttttaactgaacattgttcagatttttaagcagtacatcatcttcgggtatttgtgggttaacaggcattgaacctgttgcgccttcaaatgagagtgcaccctgagctggggccagcacagtcatttcgctttcccatttctcttgcccttcaaacaaatcacagaccgatgttatggcgttttgctgataggtaaggtcagattcaaaatgtagtttcatctcattcccttacaggctgtgcaggttagtcaggccatgttgttccagaatggcgcaaagatttgttttagcaacgttattttcaaatgcgtcatcaaggaaatagcagaccgtatctttgccagcttttaaactcttataccagtcgatgatccccttggtcagttcttctactgaagatgcagggatttgtttagcaaagcaggtaaacaatttgccaccgtcaacacaagaaacggttaatccatcaaactgacgggtttcaatgtttacactcaggtcaatgccacgtttgagcatcaactctgtgagcagatcttcttcattacggccttcaaggattgggcttacataggcatcaatctgttctgaaagggtttctgctgtggcttcccacggacggatattagatgtatcgagtttgaaaacacgaaaaccaacatcaccattccagtcaggattatcttcacgaacctttttacctgcacggcgtaggcgctcttttgtgatttctgatatttttaaagacattccatgcttcttcaaaaaagctgctgcaatggcttgttccttagtgttttcgtcaactaattctggtagttgcgcaatcacaaatttgattttcctattcttaattgcattggctgtgaaaacagcgtgaccaaaagttcctgaaccgccaaaaaaatcaagtgctatgcattcctcattagggtaagtagctatttctattatgcgaagaagagtgcctaaaggttttggtctagaaaaaacttctttgtcgaatccaatttcaataaattgttcacttcctctttcactatttacgtctctatgtgtccatgaggaggtggcttttaccgcatcccttttggatagatagtctttctccatgatgccccacatttttttagtaggcataaatttagcgtatacactctcgatttttgtttttgctgtatcaaatccccatctccatcggccatccgtaccatcatctcgaataggttttatttcgataagaccatcatttttttgatctttagagacagataatttgttttttacttcatcatagtagaaataataaaacatatcaggtcgatcttgtcttcggtccgcatcacctgttttacgtaaatccatatcacgaaagacttcacctgcttcatcaatcttattatatctttttaggattttatcatcaggttcaaacccataagttttagcatgggttatattttttgtcattacaagtatatattcatgagcagttgctatgaatttatcatcagagcgacctttaggattgtttgtattagctataagagctataaaattctcttctccaaatatctcaaaacataaactacataagttatggacttcatgttcgtcgattgaaataaaaataaagccagagtcagaaagtaagtttctggctaattttatacgggggtacatcatattcaaccaatcggtatgataacgaccactggtttctgcatttgtacttacccggacaccttcttctgtttgccctgtgatttcaagataatttttcatattatcttggaagttatcaggataaacaaaatctttcccggtgttgtaaggaggatcaatatatataagcttaacttttccagtgtagcttttttgaagaagctttaacacttcaaggttatcaccctcgatcatgaggttcttggtgttatcccaatcaacgctttcatctttacatgggcgtaaggtgccacgggaaggggtaagagcaagctgacgagcctgacgcttaccatgccagttcaggccatagcgttcttctttttcgtctacattttcacccaaaagctgttttaaaacgtcaaaatcaatgccgttttcattaaaggcttcaggaaacaatgatttaagcttggtgatgttatcagcagtgatattcattgattgcagttcgggcatttcaggcgaaagtttgttcattgaccattccacgtatctgtatcaggttactgtgtgatgggggatattttacggtaaagagtgcatttcatcaatgaacagcgtgctacagatttctttttaaatcattatgttaatgcttttattgaatgttctgtcctcgtgttagtacaattagcttttctgcgtctaccaaacattatcaggatgtgatgatggctaaactgaacaagaaacaactttctttactcaaggaaatgcctgcagaacaactcatgcaaataatttgtgatattgcagaggataatggtcaggcaaaatcctttcttattaatgaatatctgttaactccagaagaatcactgaaaaaggctgaggctgaatacaaaagggtaattaaaacaaaacgcttttatgattattatgaagcagcgattttttttgaggggctatacaggaatgtcatatttccacttgaaaagacggtatcaacgctgcctgaaaaaaccgaggcgttttgccatgatttactgctctcatttgataaagtcagcgaaattgctgatacatcagatggatcatggatggactattataatggtgctgtcgaaatatggttaaaatccctgtccctacaaaaagacaaaagtattgatgttatagcggataaaataatttccgtacttaaaggtgatgtgtattttaactttgatatttttgataagtataaaaaagaactgggatacaatgttattcgtgttttaagggaaagtcttcttaagacaggtgatgtcaatggtgctgttgagttaagtctgtatatcagggatgttgatttcatcaggcaatgctttgagaaaagaaaactgaatcagccagaatatatcattaagtttgctgagttgctggttgatgaactgtgtactgaggaggccattcaggttctcaataaaatcaaagaagataaatcagttgatcaggcagggcttcgtgataaatggactgaggtgttggctctggcgttgattgaagaaggcgagattcagcaggcaaaaacaatttgtatagacggatttaagaacaggtgtgatgttattttttataatatctataatctggtggagaaaaataatgactcactggatttgttctctggcatagcaaagaaaaaaggctttccgtttgttattcttttcttgtccgggacagatagttatggaaaacttgattctgaagtcatgaatgcgagtgaaaatgaaatcgcagagatgatgtctttattacgcggttcttttgttcgtaccttatcgagtgagctttacaggcatggttatgcatgttctgcaactctgctccgtagagtgctggcagaggacagtatcagtcgttctcagagtaaatactacacctatgcggcatctgatatgaaaaaaagcattgattacagtaaagatattgcatggactgaaaaaatcccttcaacagaagagtatttaaaatctctgtttattgagcacaaaagaaaatacgcactctgggaaataatgctggaaaaaatcgctggtttagcgatagagaaagattcagtatcatattcagcatagactgtaattaagcatgaagttgaaaggccgcgaacggcctttccctttatttatttgaatcaaactcaaacggcctgaccatatcgttgctgttagcatcaaggaaatcagcccaccactggagcatcaggcggcgctggtcaaggtgttttgccttgtgggtataagcagcacggacgctattgctttccttatggctcatttgaagctctacagcgtcttctgaccatagcccggactcaattaaggcactacaggccagagtgcggaaaccgtgtccacagatgtcctgctttgtgtcatagcccatattgcgaagcgctttgttgatggtgttttcgctcatgggtttaaacgagtcataacaaccagtaaagattaatccgtcatcatgaccttcttcataagtcagttgtcggatctctttgagtatcttcatggcctgcttacaaaggggaactaagtgcttacgcttcattttagccccacgagttgaatgtttgacgttttcaatcgcttcacgctgttcgggtatcacccataacttacttttgaaatcaatttctgaccagcgagcgaaacgcagctcactggaacgaatgaaaatcatcagattgagctgtattgccagtatggttaacctgcggcctttgtattcggcaattttgttcagtaactggggtatttcttccagctcaagtgcagggcggtgttcagtttgtggtttctgaactgcaccttccatatcataggctgggttatggcgtatcagcttttgctggacggcatgacgcaggattgccgtaatgtattgttgaatgcgcatggcaacttcaagataaccaagagcctcaacttttttcaccggaaccagcagatcacccgtatccagttcggcaacatctttgtcaccgattaccgggaagacataagtttcaaggcgcttccatacggcatcaccataatcatcagaccattttgttttcgtggagaaccacgctttggctactgttctgaaggagcgtgtattatcacgtttggctttaagctctttaacctctgcctgtttctttgcattagggtcaataccctgagcaagaagccttctggcctcatcacggcgctgtcttgcgtcagaaagagaaacagcagggtaaacaccaatagagaagagtttttgtttcccttcgaagcggtaagccatttgccagtatttcgaacctttaggggtaacacgaaggaacataccaaagccatcagtaagcttgtattccttctcaaggggttttgcattttttgctttaatatcagtcagtgacatgaaaacaccccctcatttgttggtaaaagggaaatcgaaccagcattaccagcatttttaccatcaaaatgatatggcttcgagtggtttttagtgaacgagggtgaacgactgagaggggataaccaattgatagaaatgcagaaagcagacgttagtgaacgtctgctttcttgaaaatggctcctctgactggactcgaaccagtgacatacggattaacagtccgccgttctaccgactgaactacagaggaatcgtgtgaacggggcgcatagtaacgatgtgcgatcggcttgtcaaagggggaaataagattgcgcgtttgtttgctgacaaaaacaacaaagcgttgaagttttgatctaattcctactttgccccggcatggcgcaactttgtctgtcattgcacaagtcaaatgctgtgaccttaccgcaatggctatgtaccagcgcctgatgaggcgtgaaaaattggcaggcacttggcaaataattctgagacataacgccgtagagattaagggcagggggcagaatgaactttagacgtgaaatattttgtgaaaatggttgatacaggcagtctgacgccggtagcggaaatggcagataaatttctggtgcaggcgaaaagatttccgtcaatatcacaggcagaattatggcaaaccagctttaccagcaaaagggtatggcttcgagtggtttttagtaaacgagagtaaacttgaagaaggggataatcagttgatataaatgcagaaagcagacgtcagtgaacgtctgctttcctaaatctggctcctctgactggactcgaaccagtgacatacggattaacagtccgccgttctaccgactgaactacagaggaattgtttcaacgaggcgttgaatactgggccggctataacgtgtcaacagtaaaattaacgcgccaattcaattggttaattaacccacaaagtgaggaattaatgttcggattcctcgccgtagtcgccttcggcagcgcttacccgtaagcgctgagaaggatcctggcgatagaactggcaaaaacgctgccatagcgccgggaaacgtggagcaaacagttctggcgcgctgaaaaaatactctgacaacacggcaaaacattctgcagggtcggtggcggcataggcatctatactggcagcgctttcgccaacaagatcgatttcatcctgaatattattcattgccgcgtggagatcgtgttcccagccagccacatcgcgtaacgggatgaaagggatgccgctggcgcgatcgccattacgcatatccagtttgtgcgcaacttcatgaataatgaggttgaaacccgaagcatcgaacgagtcctgggtatccagccagttcagaatgatgggcccttgttgccagctttgccccgactgtacgacacgctggctgtgcaccagacctatgtcatcttcccattcatcatctaccacaaagggcgcgggataaatgagcacttcatgaaaaccatcaagccactcaataccgagctccaggatcggtaagcaaaaaattaacgcaatacgtgcactttttaacgagtcgagctcaaatccctgtagcgctaccagtcttttctgctgcaaaaaacgttcggctagcgcaataagccgagcctgttcttgcgcggtgaggtttaccagaagaggtatagccagcgcatcatcccacggccagtcttcgttctgggttatttcttgtgctttccagggccacttaatcatcgttttgctcgtaaactcgtcacttgaacaaaattacccgaatagggtctgttaaaatgccaaattacctggcatcattgcaatatacggagagatgccggagcggctgaacggaccggtctcgaaaaccggagtaggggcaactctaccgggggttcaaatccccctctctccgccacaattcaaacacttagctcatcttctttcagcgatcagtctcacacttagaatacacttagagtattctgttagaatattacgtgaaaaacgtatcgccatcttatgctttttctgccagaagagggggccagggatggtgttatttttacttttcgatcataagtcaactcctggttttctgccccgctatttcgctgtaccccatcgggattcacagtgatgtcacttgcggcgacttaacgccgtcgtcctcggtaatcgtcgcacccggcctgttgcccgaaatgttcccctgtagacatgggcgccgggcagaagattaattgctgtcagggaaacgcgctggcgcgtggcgataacttacgctgcgggactgtcgacgctgtacagaaaatctggcctccagactggcttaaatatgcacacatgacaatacaaccggaaaatttacaaaacgcataatttgaactgagagagaaacttacaaacgaagcgacgaagatttaaacagtcgtagcgactccggtatcttgcgcgcatgttcaaataacactactgtatataaaaacagtattcgaggtatggattatggaatttttcagacctacagagttgcgcgaaattattcctctcccatttttcagttacttagtgccgtgtggattccccagccccgcggcggactatattgagcagcgtatcgatcttaatgagttgctcgtttctcatcccagctcaacatattttgtcaaagcaacgggggattcaatgattgaagcaggcatcagcgacggtgacctgctggtggtggatagctcacggaacgctgaccacggtgacattgtaattgcggcaattgaaggagagttcaccgtaaagcggttgcagttgcgtccgacagtgcagttaatccccatgaacggcgcctatcgacccatacctgtcggcagtgaagacacgctcgacatattcggggtggtgacctttatcattaaagcggtcagttgattatgttcgcgctctgcgatgttaatagcttttacgcctcctgcgaaacggtctttcgtcctgatttatgtggccgaccggtggtggtgttatcaaacaatgatggctgcgttatcgcgtgtagcgccgaggcgaaacaactcggtatcgcagcaggtgagccatacttcaaacagaaagaacgcttccggcgatccggtgttgtttgcttcagcagtaattacgagctttacgctgatatgtcgaaccaggtaatgaccacactagaggagatggtgccgcgggtagaaatttacagcattgatgaggctttttgtgatctgacgggggtacgaaactgccgggatctgacagatttcgggcacgagataagagcgacggtcctgaagcgcacgcacctgactgtcggtgtaggcattgcccagacgaaaacccttgccaagctggctaaccatgctgcgaaaaagtggcagcgccagaccgacggggtggttgacctgtcgaacatcgatcgccagcgtcggctgctggccctgatacccgtagaggatgtctggggtgtcggcagacgcatcagtaagaagctcaatgccctgggcatcaagactgctctcgatctctctgaacaaagtacctggatcatcaggaaacacttcaatgtcgtgctggagcgtaccgtgagagagcttcgcggagagccatgtctggagcttgaagagtttgcgccggcaaagcaggaaatcgtttgtagccgctctttcggcgagcgggtcacagactatgaggaaatgcgccaggctgtttacagctacgctgcgcgcgcggcagaaaaactccgcggcgagcaccagtactgctgtttcatttcaacattcgtcaaaacatcaccctttgccctgaacgagccctactacggtaacagcgccgcggtgacgcttctcacccccacgcaggattcacgtgacattatcaatgcggctgtgaaatgtctggataaaatctggcgcgacggccatcgctaccagaaagcgggggtgatgctgggtggcttcttcagccagggcgtagcgcaactcaaccttttcgacgataacgcgccgcgcgccggtagtgcgaagttgatggaagtactggaccatcttaacgcaaaagacgggaaggggacgctgtacttcgccgggcaggggatgtcgcaacagtgggctatgaagcgagaaatgctttcgcctcggtacaccacaagatactctgatctactgcgtgttaagtaacttgtgcgatcaatgcctgagatagttgctaaatcgtccccgttcttttggtcgcacaagatcacaggaacctctcacgataatgcgcatgtatcctggtttacgacatcaggaaatgtggcgcgtttattgccaggcaggcgttgtgagacgtaacttatttacgcctggtttcagccgtagcgatgggcatggataaaaagagtatggcaatcagcgtgataatgctaaaaaacaattaatatttttttaacaaaactaaagcttgctatgttcagttaaccatgcgttaatggttgtgcggtttgatacaaacttatctgaagtagtgattgtaatatttctcatcatttgttcctcttgagatctcctttaggtttttttctctctgataattttcttcaggccatttcgcccaagggctcattcaaaaggtaacaatattatgacgacgaaaatcactggtttagtaaaatggtttaaccctgaaaagggctttggtttcattacgcctaaagatggcagcaaagatgtgtttgtgcatttttccgccattcaaagtaatgaattccgcactctgaatgaaaatcaggaagtggagttttcagcagagcagggaccaaaaggtccatcagcggtcaacgttgtggcgctttaaggcaactgatattactaataaaattcacttccggtgtccatgttgccatggttcacaatacagaacatcgacattcgatgttactgagcaaaacccgtttggcgcgaaatgtattttttgtaagtcaaccatgatcacttttgataatgttggattatacattcgctcaggacaggttccgctagattttagaaaataattcatattagctccgtacaggagctttttttatgcccggatgattatcatctatagacgctgacatccatcatctatagtggcatttacctttccccaaaggtgttatttctcttgcagacagcgcctgaaaagagcgacgttgtcttcatctatccgatgaagcctggtcacctgtctttgcgccgttatccgttatttaattcttgccctataataacaagcccgcgctaagcacgggcttgaataacataaagcgtcttagaactggtagaccagaccaacacctacgatatcatcggttgcaataccgttgtttgcgtagaagtcatcatcttcgtccagcaggttgattttataatcaacgtaggtggacatatttttgttgaagtagtaagtcataccgacgtcaacatatttaaccagatctttgtcggtgtaacgccagttgccacgatggacttcctgaccgcctaaatctttgcccttagactgcaagtaggcgatggacggacgcagaccgaaatcgaactggtactgcgcaaccacttcaaagttctgggttttgttagcaatactgccattaccttcgccattgccgccgccataataggtcatgttgcgggtttcagcgtacatggccgccaggtaaacattgtaggcgtcatatttggcacctatggtccaggcttcagcggtttcaccgccggcatagttgttgcgctcattcatgccgtcgccataaccacgagcaacctgattgtccgaacggtcagaggaagagtaggccgcacccaggcttaacccgaagtcaaagtcgtaggaggtagacataccgaaaccgtcgccgttttcacgggccagtttgcggttgccgccgttacctgtaccttcaccagcaccagcaccgccgttttcattattaccctggtactgcaacgcgaagttcaggccttccaccagaccgaagaagtcggtattacggtaggtggcaacgccgttggttctgcccagcatatagacatcggtctgggtataagtatcaccgccgaattccggcagcgcatcggtccaggcttcaatgtcgtagataacaccatagttacggccataatcgaaagagccgtactcgccgaatttcagaccggcaaagcccagacgagtccaggagtttgcaccttcgccttcggtggtgttcaccttaatgttgtattcccactgaccatagccggtcagcatatcgttgatctgcgtttcgcctttaaagccaatacgggcgtaggactgatcgccatcgtcgcctgcattgtcagagaagtaacgcagaccatcaactttgccgtacaggtcgagtttgttgccatttttattataaatttcagccgcatttgctgcgcctgccactaataacgccgggacaagcagtgccagaacttttctgttcattatgtattcccttatgataataatttatatgaatatgtagccacttcaacaaaactacaaattgatactattctatgaagttcatggaatttaaaaaataacatgtaacaaagatatttaaaatatttcaatttgtttctatttggttttttataatacaggatatataagtgactaagaatatatagtctataattatcattttttatcaatgagttatgtgttttgatttgatggctgctggcgtgaatataatttgttttttatatgtatttgatgctttgattatgaaaaagcataaaaaaaaaccggcataaatgccggtaatgtgggtaatgataaaataaatgataaaaggctaataaccgaatcattctgacatttaatgctaataaaataaaacgctatcgcggtgcgtaaaaataagttgttctggttatgggttattctgcatcagagtgcgattcaattaccattcccttatttaacagcaggttcagcgccagacgcaacattaactgagaataaactatttgtggaatgaataaccagaacaggtggataaggtattccatggtcgaaatgtgactaatatcacattataatgtaattaatgtcatatgacttacatcacaaaagcggagtaaagtttgagtaccagggaggacaacgccacccgtagcatgggcggtaaattagcgttatgggttttttataccttttgcggctacttcatctgggcgatggcgcgttgcgtgtggctgatgtccgccatacaaaccgagccggttctcggcccaatcagcactcctggcagcgcaacggaaaaatggcttaacgcgctttcgctgggcgtcgtctggcttattctggggagtattgcctggtacacccggcctcgcaaaaacagggggtatcccgccgacactcagccagaaacgcgcaagcacgcaaggatgtaaagtggtggcggatatgtcaggatagcgaaccctgtgctcaggcatgtaataaaaatggtctgctataaagagagggcgtatggactcaggatactggcaatcgcagtttgaagactggctacgtcaccaccaccaggaacaggatgccgcccatgacatcttccattttcgtcgtgtttgggcaaccgcgcaaacgctcggggaaaacagtcctgtcgactggctggtggtgctatcggcatgttatttccatgacatcgtcagcctggcgaaaaatcatccgcagcggcatcgttcttccattctggcggcggcagaaacccggcgtatttttctgcgggattttcctgactttccggcagaaaaactggcgggcatttgtcatgctatcgaagcgcatagcttcagcgcaaaaattgcgcctaccacgccagaggcaaaaatcgtacaggatgcagacaggctggaggcgttgggcgccattggtctggcgcgggtcttcgcggtctccggcgcgctgggcgtcgcgctgtttgatgccgacgatccctttgccaacagacggcctcttaacgataagcaattcgcgctcgaccattttaaaaccaaactgctgaaactgccgctgacgatgcagaccgaacggggcaagcacctggcgcagcgtaatgcggattttctggtgtcgtacatggcgaaactgagcgctgagctgaaaggcgactatgaaacacgggatgatgcggtcatccagatgtttgctacgtatcagtaacccctgccgctgaaacgtaaaccgcgtcattttatgttagtctgtcggcaattatttttggccggttaaatgtatgcaggaaaatatttcagtaacacacgcccggaacctcatcgccgacgacgccggaagcgagatccaggcgatgctgagtcaattgctggaaatctacgatgttaaaacgctggtggcgcaccttaacggcctgggcgaacagcactggagcccggccatcttcaagcgcgtaatgatgaacgcggcatggcatcgtttgagcgacaatgaactcagctgtcttaaaacagagttgccgacgccgccagcgcatcatccacattacgcctttcgttttatcgatctcttcgcgggcatcggcggcattcgccgcggatttgaagcgataggcggacagtgcgtgtttaccagcgaatggaataagcacgcggtacggacatataaagcgaactatttttgcgatccgctgcaacatcgctttaatgaagatatccgcgatatcacattgagccaccgggaaggggtcagcgatgatgaggcggcggaacacattcgccagcatattccgcaacatgatgtcctgctggcgggctttccctgtcagccattttctctggcgggcgtttccaagaaaaatgcgctgggccgcgcccacggctttgcctgcgagactcaggggacgttattttttgatgtcgtaagaattatcgacgcccgccgccccgcgctgtttgtgctggaaaacgtgaaaaaccttaaaagtcacgaccagggcaacaccttccgcattattatgcaaacgctcgatgaactgggatatgacgtggcggatgccgctgacaatggcccggacgatccgaaaattatcgacgggcagcactttcttcctcagcatcgggaacgtattgtgttggtgggattccgtcgcgatttaaacctgaaaaccgattttacgttacgcaatatcgcccgttgttatccaccgcgccgtccgacgctggcagaactgctggagcccgtcgtcgaagccaaatatatcctgacgccggtgctgtggaaatatttatatcgctacgcgaaaaagcaccaggcgcggggaaacggttttggctatggcatggtttatcctgacaatccggaaagtgtggcgcgcacgttatctgctcgctactacaaagatggcgccgaaattctgatcgatcgtggttgggatatggcgaaaggcgaagtgaatttcgacgatgctggcaaccaacaacatcgtccccgccgactcacgccgagagagtgcgcgcgtttaatgggatttgaggcgccgcaaacgtaccagttcaggatacctgtctcggatacgcaggcctatcgccagtttggcaactccgtggtggtgccggtatttgccgcggtagcaaagctgctggaacccaaaattcaccaggcggtgacgctgcgtcagagagagacggcagatggcggacgttcacgataaagccacgcgcagtaaaaatatgcgcgcgatagcgacccgcgatacggcgattgaaaaacgccttgctggcctgttaagcgcgcaggggattacgtttcatactcaggacacgacattaccgggcaagccggactttgtggtgaatgactatgattgtgtgatttttactcacggctgcttttggcatcatcaccactgttatctattcaaagtaccggccacgcgaacggctttctggctggaaaaaatcggtaagaacgttgagcgcgatgagcgtgatattcagcgtttacaggcgcttggctggcgggtactgatcgtctgggagtgcgccttgcgcgggcgagcgaaattgagcgacgcggcgttggcggagcgcctggaagagtggatctgcggcggcggcgccagcgcgcagatcgacacccaggggattcatctactggcgtgaatcttccgttttacacggtgtgatcaccgccctggcgggaaacaggtacttacccagagtcactagcactacggcaaacacaatcacgcccagcgcggcccattcaacgggcgataacctctcaccgcctaggccagtgccaagcaacacggcgacaaccggattcacataggcgtagctggtcgccagcgccggactgacgttgcgaatcaggtacatataggcattaatggcgataatagaaccgaataacgccaggtagccgacggccataaaccccgataaaccaggcagcgtggcgagcttttcgccggaaagaaacgccgcgcaaagcaataccacgcccgccgccagcatttcaatcgcgcccgccatcatgcccacaggcagggcgatgcgcgagccgtaaacggaaccaaatgcccagctcatcgaacctatcaggatcaaaatcgcgccccacggattgccgcttaaattaccgccgctgttcagcagaataatcccggcaagtccaatggcaatccccacccattctaatttgcgcgttttaataccaaaaaagtagctaaagcacagcgtaaatagcgggacagtggcgaccacgacggcagcaatgcccgatggcacgttttgatgctccgccaccgtcaccagaccgttacccaccgccagcagcagtaggccaatcagcgcggcgttgatggtctggcgcagcggcggaagtttttcgccgcgcaacagcaaaaacgccatgagcaacatccccgccgagagaaaacgtacgcctgccatcattagcggcggccagctttcaacgcctatgcggataacaaaataggtagacccccaaatgatgtacaaggcaaaaagcgcgccaaaaagaggtaataactgccggaaacgcataatcactcacggtgaaataaaaagggtgaatatagtaaacgtcaaaattattatgctggcgagcattataattgtccttttggaataaaaaggcgttgacccgcgccgccggtttcggcattgcgcgttttgctacatacttaacgtcttagaagaaaagaccgaggaaatcattttggcaggaagtagcttactgacattactcgacgatatcgccacgctgctggacgatatttcggtaatgggcaaattggccgcgaaaaaaaccgcaggcgtactgggggacgacctgtcgctcaatgcgcagcaggtgaccggcgttcgcgctaatcgcgagctgccagtggtatggagcgtggcgaaaggatcattaatcaacaaggttattctggtgccgttggcgctgttgataagcgcatttatcccgtgagccattacgcctttattaatgttaggcggcgcgtttctctgctttgaaggggtagaaaaagtcctgcatacctttgaggcgcgaaaacacaaagaagacctggcggagcggcaaaaacgtcttgaggcgctggctacgcaagatcctttggcctttgaaaaagataaagtaaaaggggcggtccgtaccgatttcattctttccgctgaaattgtggcaattaccctggggattgtcgcgcaggcaccgctgcttaatcaggtgttggtgctggcggggattgcgttggttgtgaccattggcgtgtatggcctggtgggtattattgtcaaactggatgatatggggtactggctggcggaaaagcgtagcgtgctggcgcagggcgtcggtaaaggattactgattatcgcgccctggttaatgaaagcattatccattgtcggtacgctggcgatgtttctggttggcggcggaattgtcgtacacggtattgcgccgctacaccatgccattgaacattttgcgcagcagcagggggctttcatggcgcatacgatccctgcggggctgaatctggtgctcggctttattatcggcgccattgtggtggcgctggtgaaaggtgtggcgaaaattcgcggtgtttcgcactgattttctacaatgaattatgcaaaattgtccatcctcgtctaaggtgaaaacgtttcatctgatacaggaggcaggtatggtcttttctgtcagtgaggaagttaccgtgaaagagggtggaccccggatgatcgtcaccggttattccagcggaatggtagagtgtcgctggtatgatggttttggcgtaaagcgggaggcattccatgagaatgagctcgtgccaggcaaggaaaggcgcgtgcgggatgaagcccgatgacaaaacgcccggttaatgccgggcgttttgctgtggagaaaaagagtcgtcgcgctgcgacatgctgctacctggttatgccaggattgagtggtatcccttgatgaggtctggctaccgtaagccatcagggggcgttgtatcaataaccaggagttaccagggtgccgcacgaaacactgttagacaatcaaggctggtttaaaaagctggcgcggcgttttggtcccggtcatgtcgtcaacacctgttttctgatcgtgatgctgttctcgacgctacttacctggcgggaagttatgatactgaaagacgcgtatgtcgccagtcagcgcaatcatctggggagcgtcgcgaatgtccttgaccgccaactgcaattcaacatggacaggttgatctttttacgcaacggtatgcatgaagcgctggtggcgccgctggctttttccgcattgcaaagcgcggtgacgcagtttgagcaacgacgcgtcagacatttctggcaactggagttggataaacggcggacattgccgttatatggcgtttccgatcaatttgtcgcccggacgacgcttctttcgcgggagagtcgtgacctggcaaatgaattaaccgccacgctggagttagggtatctggcgcgctcatccgccatgctgacgctggagacgatgtatgtttctcgctcagggttttacctctcaactctccctacggcgtacggtagcgatattgtttcccgttactatcagtacgtgacccagccctggtttatcgagcaaagccaacggcgtaatccacagcgcggcgtgcggtggtttacctccgcacagccctatgttgctgacgagcagaaaaaagtgacagccagtctaccgctggatcacgataattactggtatggcgtactggcaatggatattcccgtcgcgtcattacagcagtttctgcgcgatgcggccgaaaaggatattgaaggggaatatcagctatacgataaccatctccgtttgttgacggactccgcgccggaacaacaaaccgagaatacgttaaatgaccgtgagcgcgccttactggcgcgtgaaatagaaaaagataccctgggcgggctgcgtttaggaacgcattatgtaagctgggagcggctggatcattttgatggcgtcctgctgcgcgtgcatacattacgtgaaggtatacaagggaattttggcagtattagtatcgcgctgacgctgttatgggggctttttacggcgatgctgttgatctcctggggcgttattcgacatatggtcaaaaatatgtttgttctgcaaaattcgccgcaatggcaggcatggcacgatccgctgacccggctatataaccgtggcgcgctgtttgaaaaagcgtccaggctggcaaagcgctatcgggaagcccgccagccattttctgtgatacagctggatttagattattttaaaagcgttaacgatcgctttggccatcaggcaggcgatcgcgtgttgtcccatgccgctgggctcattggcagcaccattcgagcgcacgacatcgccggacgggtagggggcgaagagttttgtatcgtgctgcccggcgcgacgaaagcgcaggcgctgcagattgccgaacgcatacgccagcgcattaatgacaaagagattctggtgacgaaaagcacgacgcttcgtatcagcgcgtcaatggggatcagtagcgcggaggaatacggcgactatgattttgagcagttgcagtcgctggccgacaaacggctttattacgccaaacagtccggacgtaaccgtatttgcgccagcgacgcgactcaggagcgggaaaagaaatagtccattccttcgcgccagccatccggcccttcgttctggctacggtagacgcgctgaggatcgtcgttacgcaaatgtacaccctcccggtttagccctttaacgacaaccgcataatccatcacatccagtaagggcgcatcattggggccgtctcctagccccaacgtcagaggacgcgcgcgccactgccgacgatatgcttcaattagccagttggcagcctgatctttaccggcggaggcgtccagcacatgccagaaacgggcgccatggacaaattgcagtcccaggtcatttaaacgggcgacaaactgcgccatgcgttcatcgctatcgcgccagatcagcgacaccgacgcttcatgcagacgggttagggcagactgtgcccggtttaggcccgtccattcgcttatcacctgatcgtcaacgtcatcaaacgtggtgaacttaaactgttccttttcacgcaacttatgcaggacgaggcggatttcgttgtgagaaataccggctatcaggcggggatagttgggatggtcttcccaatgaacgtccagttggatcaccgcgccgttttccgcaatcagcggcagtccctgtagatttaacgtcgtctggagctggagcatttcagccgcggttttactgctacagaggatcacaggcacgccgctttcatgcaggcgtgtaagccagggggccgcgggctgccactcaaaagtgtggctgttcagcaatgtgccgtccagatcggtaaaaatcagcaaggggtcatggattgagagcattttttcctcattttccgttgcaacggcgggcttatttccaggaaaaatcctaaagcacatccgaaagaagtcgaacgctaactggaaccgatcccgtcgcttccaggcagcacatgcgttgtcacacttttgctaccgaactattagcgcgcttaatcattcatgtaaaaaatatttacttgtcatgcaaaaaaattgcagataaagtaaatctcacatcagatttcctggtgtaacgaattttcaagtgcttcttgcataagcaagtttgatcccgacccgtagggccgggatttttttcggccatttttaacggtttacttctgttacactaaaatcatgaatatccagctcgaatgcttcagctaattcatgccatgtatgatattcccgtccgtctacgctcacccgctcaggatcttcctggctacggtgaacctcgctttcgctgatttcattgatggccgccagtagcgcatctacatcgacgctcacttcgcgcttggccgtatcactgtactcttttgccgttttcatcttcactacctcacgggttcctgacagcctaagtatagaccgttgagaaaaccagcaaacacgccggcaaggcgctgtcagacgcagaaaattgttctacactggcacaaagcgacaggaggaaaatgatgaaggtgaatgatcgggtaaccgttaaaacggacggcggtccccgccgaccgggcgtggtactggcagtggaagaatttagtgaaggcacaatgtacctggtttcgctggaggattacccgctcggcatctggttcttcaatgagtcaggtcaccaggatggtatttttgtcgagaaggcggagcaggactaattgagccggactggaggtacattgccagtccggatgtctcagcgcatgttagcaaaaatgccgttagtgacgttatctgtcagccgcactacgtgatagatcacttgtttattatgcgtttttatctttctttttatattccccttatgggaggatactgtttttgctttaatattcattctgtcagaaatctgaatggttccctgaccttccatccacattcgtaacatgctggattcagttcgacttaacgataatgttggtaaatttatggttcctgaaatacccgactcttttttcagaatatcgccaagaagggtatccagcgagtcaggtttaatcgatttagagctaatcaataagttttttcttactaataaatattcatcaaaatgcacattagcaattgccataaaaacaataaataacgtgtcaggatgctgattaatgatttgctttatttgttgactgtctgaaggcgtatgaatgaaacagtcctcattaataaacaccaccgaaggctgatgtgcgccacaagcgatagcgagttcgtcaacggtttcgatgtcgttgatttccctttttttcacccctctgctgaccagatacccgcttaaccctagccgggtgtaactgcataaatccataataatcgttgacatggcataccctcactcaatgcgtaacgataattccccttacctgaataactcaccataatcagacggaacacgaatagtcaccttagacaacgcttacgcggtttttcaggcgaacttactatcccgtaaagttacatataatttgccaggaatcatcttaaagtaaagtgaatgttgcgttatgtgagtgaagtaaaaacaaataaggggcagcggatatatcctggtgaatgttttttaaaatttattttcggataaaccttagtaaaacaggataaaaattatgggttattatttatcggcatctcgctaacaatatcagcaagcaaattgaaaatttcgctgaataaatgttcgcaaaacggcgcaattaatggcattagcgcggccatcagcataatgccgacggtgagggtaagcgggaaaccgataacaaatatcgagagctgcggcgccatgcggtttaatagccccagcgccaggttgagcgtaagcaggagggtaatgaccggcaatgccagcatcagtccgtttaagaaaatgagccctccggccctggcgagcgccataaatgcattactgttcaccgggttactaccgatgggcagagtatggaaggtatcgaccagcagcgaaataagccacaaatggccattaaaggtgagaaacagtagcatggcgagcatatccataatacgcgccagaaccggcatattcaagtggctgcccgggtcgacgaaggtggcaaaggaaagccccatttgcagaccgataaactcacctgcggtacgcaccgccgcaaaggcgaattgcatggtaaatcccagcgcaataccgatcagaatttgttgcatcgccagccataaggcggcaatagaaaaaagcggcgtatcgtttgctggtagcgacggcgcgataacgagggtaatcattattcccaaccccagttttacccgcttgggaatagcgcgctcgctgagaatgggcgccgttgaaatcagcgccagtacgcgcagcaaaggccagaaatagagatgcagccagtatagccattgctcgcttataacctgtatcatcgttctgtttatccgatgatataaggtaaattgctgaacagagtgcgtacgtagtccagcagcaggttgagcatccacgggccggcaacgataattgcgatgaataccgcgacgattttagggataaacgacagcgtcatttcattaatctgagtcgcggcctgcaagatgctgataatgaggccggtaatcagcgcgacgagtaacagcggcgcagccagggcgagagcaactttcatcgcctcggtccccatcatcatgacggattcaggagtcattttgcgcctctaactgtaaaagctttgggccagcgaccccacaagcaattgccaaccatcgaccagcacaaacagcatcagcttaaacggcagggcgattgtcgctggcggcaccatcatcatccctaacgccatcagtacgctggcgatcaccaggtcgataatcaaaaaagggatgaaaatcgtaaaaccgatctgaaacgccgtctttaattcgctggtgacataagcgggcaggaggatacgcatcggtactgcttccggtccctgtaacggaccgctattggccagacgggcaaacagcgccagatcggcttcgcgggtttggcgcagcatgaacgcgcgtaacggttgcgcgcctttatccagcgcttcctgcatagaaattttctgctcgctaaacggctggtaagcatccacgtaaatcttgtcaatgacgggcgacataataaaaaaggtcaaaaacaacgccagtccgagtaacacctgatttggcggtgccgagggcgtgcccagcgcgttacgcaacaagccaaaaacaatgatgatacgcgtgaagctcgtcatcatcagtaaaatcgccggcagaaacgtcagcgaggtgatgaaaaccagcgtctggacggataatgaccagctttggcctccgcccgctaatggttggctgataagccccggcagttgcgcagcggcggcgggactaaaaagccacagacccgccagagaaaggaataacaaacggcgcatcaggatctcccggaacgcttgagtaagctcttcatcatgttctggaaatccgccggtggggcaacgggtgcttccgtgtcattctccgcgggcgggagggtgtgcagcaggttgatctgcgaggcggtcacgcccagtaccaggcgcgcattttcgacctcgacaatcaccacgcgttcgcgcgggccaagcgaggcgctggctgacaccttcagtccccggacgctatttccttttggcgcgaatcccatacgcttaatcacccaggccgccgccagaatgagcgcaataatgccaattaatgcgccgctcacctgcatgagcggcgatccggctggcgcggtgggctgagaaaccgtggcctctgtcttcatcattaacgactcaaacgacgcatacgctcggatggcgtaataatatcggtgatacgtacgccgtatttatccgccacgacgaccacttcaccctgggcaatcaggtagccattaatcaggatgtccagcggctcgcccgccagcccgtccagcgcgacgaccgacccctgcgtcagacgcagcagttctttaatggtcattcgcgtgcggcccagctctacggtcagtttgaccgggatatccataatcagatcgatatcctgcatagcaccgctgacatcgccgccgccaagctgttggaaaaccgcgtcggcggcgcttttattggtggtcgcttttttctcgtttaacgcgtcagcccacagatcatccaatgcgccagtattctcatcggacggattattcatgtcactcatttgggctgttcctcattcagcgaattcaaaattgggttgatcaaatgttctacgcgtagcgcatactgtccgtttacggtgccatattggctggtgagtaccggaacgccgtccacatgagcaataatgcggtcgggtttttcaatcggcagtacatcgccgggtttcagcttcaaaatctgggaaagacgtaacggaatatcggcaaaattggccaccagctccagttcagagtgctgaacctggcgcaccaggttatcacgccagttctgatcttcatggcgcgagttttccagcggcggattcaccagcagctcacgcagcggctcgatcatgctaaatggcagacagatgttaaattcaccggtcagattgccgatctccacatgaaacggcgtattgacgacgatatcgttcggcgaggtggtgatattggtaaatttcacctgcatttcggaacgcacatactccacttccagcggattaatggctttccatgcgtcgctatagccttccagcgccagtttcagcatacggttgatgacccgctgttccgtatgggtaaactcgcggccctcgactttggtcggaaaacgaccgtcgccgccgaacaggttatcgacggtaataaacaccagactcggcgagaacaccaccagcccggtgccgcgtagcggcttcaggtggatcaggttcaggttggtcggtactggcaggttacgcgcaaattcgtgatacggctgaatacgtatggcgcccacggtaatatccgggctgcggcgcagcaggttaaataatcccatccggaactggcgtgcgaaacgctcgttaataatctccagcgcctgcaagcgttcacgcacgacgcgacgctgggtattgggatcgtaagggcgaatatcgctatcgcttgcgataccgggagtgggttcgtctttggtgtcgctgtcgccgttcaacagcgcatcgatttcagcctgagaaagaatactatcgcccatatcgttaccgcagaataaaagctgtataaagcacgtcagtgacgacctgttttggttgtccggcaacgagcggcgcggccagcgtctctttaatggcggcaatcagtttttgtttgccagcttctgttgagagctcggcggcattctgacgggaaaataacaacagcagacggctgcgcacttccggcagatattcatttaatcgtgcgcgcgtcgcttcgtctttcagacgcagggtcacgccgatatacaacacgcgatccgcatcgcccagattgacggtaaacgtatccagcacaaaaaataccggcgcgggcggcggagccggttccgctttagcgttcgtggtcggttgctgctgcatacgccagtagctataaccggcagtcgcgcaggcggcgagggtaatcaacaccagcaaaggtatccaaatcgagcgtttgctctttttgttaatcgcggagtcagtcatctgatacgggcttcctgtttcggtactgcttattggctgattatcccgtgtcctgtccacgacaaagcgtggaaaagacgcggataatcatgctacctctggcgttaggcgaagatatccactgcgccattgccgcgcgcggcggcctgaagcgaggccggcgccgctaacgctatatcatcttcagcgccaaacgcgtctgtgtgttgggcgcgggcagactgttgttgcgatgaagactgctgctgtccggcaaagctttcgctactgatactactttgtcccaactgaatgccgctttccgccaactgggtgcgtaacatgggcagggcggcttccagcgcggcgcggacatggctgtgcggcgataccatctggagctgcgcctgattgtcatccagcttgagcgaaatgtgcacctgacctaactcttccggatgcaatcgaagctgcgcgctttgctgtccctgacgcgtaaataacatgacctgctgactgaacgtttgttgccattcatggctgcctaacggcgcgctgagtaccggggctgaggcgacaggtagcggttgcggttgcgccgtggcgctgctgagcgtcggcattgccgcgccatgcgttactggcgcggacgggctatccacctccacctccactttcgcgctggtcgcggcggcagcgaccaccagcggcgtcagtgatggccccatggcgcgatcgtcgctggcgcgcgcaagcgacgcctcggttttccctttttcatgctcgctaaaagagagcgtatgtgtctcttcctgcggcgccgatagcatgtcgccgcgtaacagtgacggcaaggcgatgtgattttcagccggcgtttctccggcgacaggcgtcgcgacaggttgtccgggcagcatggcgaataaggcgctcagactggcaagatcctcatcgctcagcgcgggcgttttctcatcatgctgcgccgttttactcaatgcggccagagcgctggttttcaacgatggcgttagcgtagacagtagatgctgcgcttgtgtcagattggtaagcgtttcatccgtcgcattcgctttttgcgccagcaggtcggcaagcttcaccgcctggcccggctcgccatgttgggccagtagctctttcgataacttgccgcctgccgcctgtaaatcggccagcgtgatgcgggcgtctttgccctgtgcgccgtctgcgcctaacgcgcccgccaggagcgccagaaagtcctcggctgaaccggtggtttttcctgacgtcagacccgcggtcatgtcggtatcggtggtgatcagttggggcagggtgatcattcgggtttcctcattgctgcacgctgagcaaattcatccatctttttctgatccatgcggttttcagctaacagcgctgccgcggtttgtcggtcctgtaaggtttgccaggcctgaagtcgctgctttttctcacgccagctcttcagcgccaggtcgactttttgcgtccactgcgtaagctggaggcgatgctgctctatcgccttttccagtgtctgaataaactgctgatagttgatccagcgattactggcgatgccgttgcccatatcggtgttcaaattactgcgatactcattctgataatcgatcagcattttgagctgttcttccgcctgttggcagccgcgacgcatttcgcccagtaaacgcgccgcgtcatctacctctttttcggccagatctttgagtgtttccagagcgccatgttgtgccatgatcgtcgccctcctgatttatcacaccgtcgggaaaattaaatcgagcgcctgaagagagtcctcccagtcggcccgttcaaaaatgccttgctgtaaaaacgcttctaattgcggccataaggtaatggctttatcgagcatcggatcgctgcctttggcataggcgccgacgctgatcagatcgcggttacgctggaaactggaaagcaattgtttaaatagccgtacccgcgcatagtgctgctcggtaatgagcgcggtcatcgcccggctgattgacgcctcgatatcaatggccgggtagtgcccggcttccgccaggcggcgggacaagacaatgtgcccgtcgaggattgcgcgtgccgagtcggcaatgggatcttgttggtcgtccccctcggtcaatacggtataaaacgcggtgatagagccgccgccgtggatgccattaccggcacgctcgaccagcgctggcagctttgcgaacaccgagggcggataacctttggtggctggcggttcgccgattgccagggcaatttcacgctgcgccatcgcatagcgcgtcagcgaatccataatcagcaacacatgctgtccgcgatcgcgaaagtcttcggcgatgcgggtggcataggcggcgccctgcattcgcagcagcggcgaaacatccgccggggcggcgatcaccaccgaacgcgcgcgaccgtcggggccgagaatattttcgataaaatctttaacttcgcggccacgttcgccgataagacccacgacaatcacgtccgcccgtgtgtagcgcgccatcatgccaagcagaaccgatttaccgacgccggaaccggcaaagagtcccatacgctgaccgcgccctacggttaacaacgcgttgatggcgcgtacgccggtttccagcacatgttcgattggcgttcgctgtagcgggttaaacggcggcgtgattaacgcgccggtttccagcgtatccggcgcaggcagtccgtcgagcggtttaccgccgccatccagcacccgaccaagcagggccgggccgagcggtaactgtttgccgctttgcagaccgtcgccatgcccgttacgggcgtaaacgcgggcaccgggcagaatgccttcgacctcttccagcggcattaaaaacagacgctggccgttaaaaccgacgacttccgattccacctctttggtttcagggccgtcctggcgctcaataatgcaggtggcgcccagcggaagctggagaccggtggcctccagtaccaggccagtggcgcgggttaaacgtccataacggcgcaccgccggcaataacgccatttttgcttcaaagttgtcgagcgcggtaagccagcgggtcaggcgcgtggtcatcagagcactcccggcgccgccaggcgacacaactcttgccagcgagtggcgacgctggcgtccagatcgccctcatcggcagagactttacacccgccgtgatgcaacgttggatcgccgcgcaaccgccatccgtgaagactgagcgtggcgcccagcatctcttccacccgctgtaagtcgtccggatgcacgcgcaactgcggcttgccgctaaagagcggctcttgctgcaacagttgttggatctgtttaatcagcgctgagttgtccaccgccggcgtttggccgatgacctgacgtgcggcctccagggccatttgcatcagccgtgaggcgataacgctatcgagcgcgtcaagcgtgttctgaaactcgctcactaactgctgcatacgggcatgaatcggcgcctgctgcgtctgcgcctgggcttgtccttgctccagcccttgcgctaacccttcctggtatccctgcgcgtgtcctttttgccgtccctccgccagcccggcgttataaccttgttcatgggcctgtatttttagctgcgccagctcctgctccagctgctgttcggcagtgagttcgggctccggcgtatcgtctgtcaaggtaacgttatcagcctcaaccggcacaaacgtctccggcggcggagcgagatcgtcgggggtccagacttgccacggcaattcattagacataggtatcctcgccgctgccaatcaccatttcgccggtttccgccagacgacgcacaataagcagaatcgctttctgctcgttttccacctgagacagacgaaccgggccacggttggcaaggtcgtcgcgcaggatatcggcggcgcgctgggacatattgcgcaggaacttctcgcgtaatggcggttcggcgcctttcagagcgatcagcagcgactcggaatccacttcctgcagcagacgttggatactgcgatcgtccacatccaccagattttcgaacaggaacatctcgtcgatgattttctgcgccagttcgccgtcgaattcgcgcacagcggtaataaccgcttcttcctgctgcgttttcatcaggttgataatttctgccgcggttcttacgccgcccattttgctgcgtttcaggttctgaccgtcgagcaggccattcagcacttcggtcaactccgccagcgccgccggctgtacgccgccaaatgtcgcgatacgcagcatcacatcatgacgcagtcgttcgtcaaacagtgccagaatatcggcggcctgactgcgtttgaggtggaccagaatggtggcgataatctgcgggtgttcgtcgcgaatcaggtcggcggcgctctgcggttccataaagttgagcgtttcgataccgctggtggtatcgcgcgtttccagaatatcttccagcaggctggaggcgcgttcttcgcccagcgctttaaccagtacggagcgcaggtattcgttggcgttgatattcagcgcggcgaactgctccgcttcttgctcaaactctgatagtacgtccgtcagttgtttgttggagatctgacgcacgttagccatcgccgtacttaacgcctgtacttcgcgggtggagaggtgtttaaacacctctgccgcccggtcttcgccaatggtcatcaacaaaatgacgcttttatcggtaccgctaagattactcatgatcgttactcatccactggcgaatgaccagcgccaccacgcgcggatcgttgtctgacatttcgcgaatacgctggctcatcacctcagcgcccagacgctggttagcccggcgttgctggagctgctcgtctttgctaaggcgtacttccacggcttcttcggtttcctggcgaacctgcgcctgttcctgcgccgctttcgcttcttcaacgcggcgcgtcaactgtggatgtaccgctttgcgccacagaatccaggccaccaccagcaccagtaaccagcgacctgccgcgagcaactgatcgataaaggactgctgttgccagaagggcagttcgccgccggtgttatccactgcgctaaacggtgaattcaccacgtttagcgtatcgccgcgtttatcagaaaaacccatcgcttcacgggttaaatcctcgatctgtttcatctgatcggcggtcaatggcagcggtttgccatccgccagcgttttgtaattcaccacgacagctacagagagacgctcaatatcgcccacattcattttggtgtgacgaatggtgcggtccacttcgtagttactggtttcattacgctgcgtattgcgcgggccagcgttgttactgttggtactggtgctggtttgtggcgtattctgcgcgttttgttgattggtcggcggtgtggcgatcggcgcctcgttaggcggcgctggttggttcgacagcgcgccaggcacgccgccgggatagcccgcgcctacctgttcgctaatattcaactgacgtgaacgcagagtggccttcgacgcatcgccgttcgggctgtagtgctcttccgtctgttctttattggcaaaatccaactgggcggttacctgagcgtgaacattaccgttcccgacgataggcgacagaatggcttcgatacggcgttggatgcggctttccacatcattagcaaattttaattgcgcgtcattaaggtcgcgaccgctggtattggattgcgtgagcagatgaccggattgatcgaccagagtgacgtttcctggcggcaaaccggcgacagcgctggaaaccagatgtaccacggcgctaatttgtccttcatccagcgcccggcccggttccagtgtgacggtgacggaggcggaaggggatttttgttcccgcacaaatagcgacggctttggcatcgccaggtgaacgcgggcgctttttaccggacccagcgtctcgatcgtccgggccagttcaccttccagcgcgcgctgataattcacctgctcgctgaactgactgataccgaatttttcctgatcaagcagttcaaagcctaccgcgccgcctttaggcagcccctgctgcgccagacgcagacgcagttcatgcactttgtcggcgggcacttcaatcgcgccgctgccattggcaaagcgataggggatattcatctgggtcaactgcgcgacgatcgcgccgccgtcctgatcggaaaggttgctaaatagcgtgcggtaatcgggcgttttggcccacagcaccatcgcaacgacgatcgccacggcggcggaacccgccacaattaacggaattcggggattcgcgcgtaggcgattaagccactcgagaggtttaggttgggttgcagtcgatgcagtcgcactcatctcgcacctcgtgactgatcgtggacggcgttttttgcaaagtggaacaagactcactcccgggtcagcaaactcgaaaaattgacggtctcattatttgtggtttcgaatttttctatgcgctaaaaaccgaggttttttatcgttatttaacgcctttatcttattgacaaactggtaatctctgctgcgtaaaaaatcatccaggggaataacatggcagcaatacaggggattgaagggggtattagccagttacaggcgacggcgatggccgcaaacgggcaagaaacacactcgcagtcgacggtgagttttgccggccagctacatgctgcgctggatcgtattagcgacagacaaacggcggcgcgcgttcaggcggaaaaattcactctgggtgagccgggcattgcgcttaatgacgtgatggctgatatgcaaaaagcgtccgtctctatgcaaatggggattcaggtgcgcaataagctggtcgccgcgtatcaggaagtcatgtccatgcaggtttaagccagggctgacaacacatccgcagcgaactcccgggcgcttacctaagtcagtggcgggggacgcgacgcccatgcaaccagtgcgtgattatgtgggcttgtttttgcgaggcgcgctcattttattgataagcgggttgcacattgttgcagggacttattaaaaatagggtacgcctgtttactgacgccattcattcctactattagttctgaggctattgtcattgagtttgcaatccagaatgttcctgcaatatatgcgccgttgcgataatacacggtaaattctttactaatacctggaatatctgtttcatggagatccagtatatacccatacggggacagattatcagcgagacagcgggcaatggcgctcggatgtgcattgactactgtgacgggtgagtaacgggcagcggcaagacagacgactccaataatggagatgaaaataatttttatcatttttttggcttctgctgtgcataaataaatcatcacctgataatgtcagtgagtaaaaatataaatacctgatagtcttttatgacgtagagggaaaataataattattttatgttttgcttaaaatagtcatggttttttcatcggctcagacaaaattaaaacggtatacgttatataatagatttatgccacggcgcacaagacgaccttgtctgatttcttttatgcgttttagatttttgccggttatgccgtaaaaggtctcccgccgtaacgtacagcgggagtatgcgcttatttttgaatcagataacgaattgtcgggccatcctgctgaatatccagcaccgtataaccgtgattgcgcgcatccagtggaatattattaatggactgcggacagtcgctgaccacttccaggatctcacctttttttagctgcggcatcgcttccagagtggcgaccgccgggtacgggcaaggttcgccaaccatatccagacggtaatcagggacgatatttttcatacagattccttagcaggcgtcagccccgcacggcggaaaaaacgtttttcccagccgatgattaacatcagcgcggtaaataacaacagataggtgaccagcagaccccccagcggaccaaaggtattcagcaggttaactttatcccaactggtcgccagcgcgggcgcgaaatcatcccagtagtaagccaggatggtcgaaccgatgacattgccgaggcccacccaccagtaatgcacctggacttctacggcgcggtacatccagccggtttcgcagccgcccgccagcacgatgccaaaaccgaacagcagtccgccaatgaccgcattcgggccagcccacataattttaggtgcaacgcccaactgcacgtagctgaaaataccaatggcgctgaccgccatgccaaaaataatcgctttcgccatatgggcgcgtccggagatccacagatcgcgaaaggccgaggtaaagcagatttgcgcgcgctcgatcagcagcccaaacccgacgccgaacagcatcgccagccccagtttcggctgatgcattgccgttaataacgcccagccaatcatgccgataaagaccagcataccgagcctgaaacgccgtcttgcctgatccggtttctgcgtcagtggcgaagccgcggagaccttttgcattttcaccggtatgcgaaatatcggcagcaacgtaaagcgggcgccgaaccaggaaccgatagcggtcgccagcgcaaagaaccacgcgtgtagggagaactgcgggatcccggtaaaaaaggcggccaggttacaccccatcgccagacgcgcgccgaagccagcgatcatgcctccgaccaccgcctgtacgatacggattcggctgcgcggcatacgcagttttacgttgttggcccacagcgccgcggcgaaacagccgccgaacatgccgaggatcatcatgccgtcgatacgcgtcagcggcgtaccttccagatgaatcagcttgtagtagccccactgttcggcatgaacgccaaaaagctgcaaaatttgcccgccccagcgggtaaattcgcccgtcacggcccaaaacgtgccggtgatgccaaaatagtaggtagagagaataccggctgcgatcaccgcaggggccggcgcccagaatttaattaaccaggtttgcttgaagtgttgccatgacatgtgtttagcctctgaactcagaaggtgtgaaacaagaagtgcgcatactacaccgatcacagaatttgcctacacctaataagcggtaataccgactggatcaaattgcggccagcgcctggaaaggctggcggcgtcagggctttaatgccacaattcttctttcttctttcttctttcttctttcttctttcttctttcttctttcttctttcttctttcttctttcttctgatgcaggatgaatgatgaaaaaagtagcgatcgttggcgcattgctggttctggccggatgcgccgaggtggaaaactataatgatgtggtgaaaacgcccgcgccggccggtctggaagggtactggcagtcaaaaggcccgcaacgtaagctggtgagccctgaagctatcgccagcctggtggtgactaaagaaggcgatacgctggactgccgccagtggcagcgcgttattgctctgccgggcaagctgaccatgctctccgatgacttaaccaatgttacggttaagcgtgagctctatgagattgagcgcgacgggaataccctggaatatgatggcatgacgctgcaacgggtcgctcgtccgacgccggagtgcgccgccgcgttagaaaaaacgccgctgccgacgccgctgccgtaatttcgcttcccggcagcgctctgccgccgggaacgctcatcacacgtcctcaatgacccacacgctgacgctgcctgcgttgcagaagaacgtcgcttcgccttgatcattagttacaacatgctcactgcggtttcccagaaaatcacgccaggtcttgttagcgtaattgtcgccgagcaggagggttttttcaccgtcgtcgccattggaaagtacgaccacacagcctggattctcttcagtaccgctgcgactaaaggcgatacagttgggatgatcgaaaaagagtgtttgtataccgtgcgcaaaacgctgacgagcgaggatcagccgatccagttggttaatcaccggcatgtcgacccgacaggtctcgccattttcgccgttatcctcatagctggcgccgtataaatcgggataaaacaccgacggtacgccgttttcacgaagcaggatcagcgcataggccaatggtttgaaccagggttctaccggcgcttccagcgcctgtaacagttgtgtatcgtggttagcgaccagcgtcaccgcatgaaaagggtcggcttctaccagcgtgccggtgaaaatgtggcgcatgtcatactccgcgccctggcgcgaggcttcatgaaatttcatctgcaacggcgcgtcgaacagcatggttttcccgtcggcctgatcgatgtacgtttgcagtttatccacttcatgcgaccagtattctgcgacaataaacagcggttttggcgcaaccgcctgtacatgctcaatccattctttataaaaccaggcgggtatatgttttaccgcgtccaggcgaaagccgtcacaatgggtttgttccatgacccaacgagcccaatatttaatctcttccgtaaccgcgtgattgcgaaaatcgatattttcccccatcagatagtcgaaattacccagctcatcatcaacctgatcgttccagccatcgccggtatagtcattgacgatcttaaaaatgccgtcttcgtcgggattctcgatgtgatcaatgccgctgaaacagtgatagtcccaaataaagttggaatactggcccgcgcgggcagggaaggtgtagcgcgtccagccttcgcattcaatgatgttgtcatcaatttgcgtgcggtcatcctgattcacgcgctgaacgcgaatacgttctttttcgtctgcgcccattttgtggttcacgacgacgtcgagcagcaccgcaatattattttttttgagcgcgtctatcgccgtcagtaactggcgtttatcgccgtactttgtcgcgatagttcctttttggtcaaattcgccgaggtcaaacaggtcgtagctatcatagcctacggaatagccgccggaggcgcctttacaggcgggcggtagccagaccatattgataccgatatcattcagcccatcagcacgttccgccagctcagaccagagttttcctccgtcgggataataccagtggaagtactgcaataacgtggggtttttcatcttccgtgctccagaagtcgtttagccgacctctggagtatggaagaattttcatacgagacgggaaaatattatgaggcgccaggtgcgtctggcacgagtaacataccggaaagacggccataagcgttgttgagtgatttttggcgggtggattgtccgatcaaactactcagttcatccagtcgctgttgcagcagccctttcaggagctgctcattatccagcgtttgtttgatgtatccggcgaccatatcctgaatacttcgcgtaatgcccggtggagtttgcttttccatcaccgtttcaatactttgcagataggagacctcttgttgcagtaagagatcccattcacctcgctgcgcaagttcaagcagcgattgactgagcagcgcaatacgctgccaacggttgataaactccacggttgaggtcattaacgagactcctggaaagatgctttcggtgaaatctgcttccaggcttctgcaatattgctgagtaacctttccacttcttcgatggcctgagcgtcgttacgcaaattagcctgcagtaaacggcgaatcatatagtcgtatagctcggaaagattcgtcgcaatctcaccgcctttttcctgatcgaggccggctttcagcccgttatcgataatattgatggctttgcttaacgcttcacctttcgcgacaacatcgccttgttctaaaaacaggcgagcgcgcaccagagcgctattcgcgccatcaaacaacatttcaatcaactgatgcgggctggcgctcatcacggcgctttccacgctgacttgcgcataagctttgataccgctcgcggtgtacatggtgacctctgttatcaggacttgttcatagctgtaaattgctgggtcaaataactactggtgttattcagcttactcatcatggtatccagttgggtaaactgggccttgtaacgggcaacggtttcatcgatgctgttgctaacggacaggtactgttttgtcaggcttttcagcgtggcgttaacgttgtcctgcgcattatcaataatgccgtcatccgccagataacttttcacttcggtggcaattttggtggtgatacccgtttctttaccatcgcctaccagcagctcacgcgctgcggccgtgttatctttcagtaccttggtcagcttatcatcgtcaatcttcagtttgccggaagtcccatcctgggtgatgccaatttccgccattgttttgaacgcagaattactgccgctattggcaaattgtgcccgaatcccggtctggatagcacgaaccacactatcgcctaacagcgcgccgtttttatcgctggcttcttcgcccggctcaacggcggtatatttagttaatgagctaaaagtatccaccagcgagttataggcatccacccaggatttaatcgcctctttcgccttggtatcatctttcgtcaccgtcacggtcgcgtcggtcactttcttggtcagggtgagtgtaattccctgaggggcgtcggttacggtattgctctgacgctcaatgtcgatgccgtttacgttcagcttcgcgttttctgctttcaccagctcttgcatattgccggtattggtggtgctgtcataagcgagtagatcgttaagttttgtatcgccttccaccgtgatcttcatcgtattgtcggtaccgctattggcggtaagcaccaactggaattcgttctctttgaccttaacgatactggcggcgataccgctgtcggcgtcattaatggcgtcacggatcgcctccatggaggtgtcgcctttatccagcttaatttccagcggctctttacgtcccggctgttcaattttaattgtccgggatgtgaccgacgtatcgcccaactgctctttggtggttgcgaaggtggtttttgtcgccagcgactgcgcggcggcaagctgggttacgctaatcttataagtccctgcggcagcgcctgcggtagtactgactttgaggtcctctgtcgtgctggacgccacggtagacttaaataaatccgctttatttaacgcggtatttgccgtctggaatttttctaatgcgcttttcaatgtgccataggcggttagctttgccgaattcgcgctctgctgtttggtaattggcgttaagcgtcctttttcgttctttgtcaggtctgtcaacaactggtctaacggtaagtttgatcccacacctaatgatgaaattgaagccatgccttcttcctttttgattgcaaacagtagttaagcgcgttatcggcaatctggaggcaaagtttaatgataattttgcaaaaataatgcgcggaataatgatgcataaagcggctatttcgccgcctaagaaaaagatcgggggaagtgaaaaattttctaaagttcgaaattcaggtgccgatacaagggttacggtgagaaaccgtgggcaacagcccaataacatcaagttgtaattgataaggaaaagatcatggcacaagtcattaatacaaacagcctgtcgctgttgacccagaataacctgaacaaatcccagtccgcactgggcactgctatcgagcgtttgtcttccggtctgcgtatcaacagcgcgaaagacgatgcggcaggacaggcgattgctaaccgttttaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgcgaatggtactaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggtgccaacgacggtgaaactatcgatattgatttaaaagaaatcagctctaaaacactgggacttgataagcttaatgtccaagatgcctacaccccgaaagaaactgctgtaaccgttgataaaactacctataaaaatggtacagatcctattacagcccagagcaatactgatatccaaactgcaattggcggtggtgcaacgggggttactggggctgatatcaaatttaaagatggtcaatactatttagatgttaaaggcggtgcttctgctggtgtttataaagccacttatgatgaaactacaaagaaagttaatattgatacgactgataaaactccgttggcaactgcggaagctacagctattcggggaacggccactataacccacaaccaaattgctgaagtaacaaaagagggtgttgatacgaccacagttgcggctcaacttgctgcagcaggggttactggcgccgataaggacaatactagccttgtaaaactatcgtttgaggataaaaacggtaaggttattgatggtggctatgcagtgaaaatgggcgacgatttctatgccgctacatatgatgagaaaacaggtgcaattactgctaaaaccactacttatacagatggtactggcgttgctcaaactggagctgtgaaatttggtggcgcaaatggtaaatctgaagttgttactgctaccgatggtaagacttacttagcaagcgaccttgacaaacataacttcagaacaggcggtgagcttaaagaggttaatacagataagactgaaaacccactgcagaaaattgatgctgccttggcacaggttgatacacttcgttctgacctgggtgcggttcagaaccgtttcaactccgctatcaccaacctgggcaataccgtaaataacctgtcttctgcccgtagccgtatcgaagattccgactacgcaaccgaagtctccaacatgtctcgcgcgcagattctgcagcaggccggtacctccgttctggcgcaggcgaaccaggttccgcaaaacgtcctctctttactgcgttaatccggcgattgattcaccgacacgtggtacacaatcaaggcagcgaaagctgccttttttaattccggagcctgtgtaatgaaagaaatcaccgtcactgaacctgcctttgtcacccgcttttcctgttctggctcggcctgtcgcgaccattgttgtaagggctggaaaatcacgctggataagacgacggttaaaaagtatctcgccagtaaagacacgacgattcgtaccatcgcgcaagaccatattattctgctgaaaaagaacaataatcattggggggaaattaaactgccttcggcgctgggaagttgcccttatctggatgaggaccgtttgtgccgggtacaaaaacgttaggcgcaaaggcattaagtcatacctgttcctctttcccacgggcgcaccatacctataaaaatgaggtacgtaactccctgagtcttgcctgtccggaggtaacgtcccgcattttaaacgatcctgacgcaatggcgctcggcgaaaaaacaatcattcagcagacattcaatactgcgccgttattctcaccgcagcaaaagttactcaatctgttttgcctgagtctgatcaaccatgccaacagcagtacggaaacggcgctctatgggttgattaaattcgtcatgtatgcacataaatttgccaaaattgatgatgccgcgctgggtgaactggaacaggtgtatgccgcgttacttgagcagttgcagaccggcgtgctggcgcaggaattgatgaatatcgcgccggacagcaaggtaaaaacctcgctggtattgcagatgcagaactatttccgctcgctcccgcttagtcgtggcagtgttatcctcgatcactatatccagtgtcttctgcgggtgctgacggcggaagagggcgtttcaatggagcagaaggttagcgatattgagtcctcattagcgcgctgtttacaggcggatgagcagcagaagaactgggctttcagaaatttaattctctataaaatttgggaaaataatttccccaaccagccgaatgtcgacccgttacgcgcgctgtatattatcgtggcggaatatgcctttattaagctattaacggcagccagcgtgcatgagcgcgggcggcttgagtgggatgacgttaccaatattgtgtatagctttcactcccgcagccagcataacagcgaggtggcggcgaattttcatcgccatatagaaacggtgcgtactggcgacgatctgtcgatgattcatcttctgacatagttttgttcggggtgggcttttgcgcatcccgtttatcctatctggctgattttattctgctctttgaaccgctaaaaaggcgctacaggttacataagtgaaataacccttcttttatagccttattccttcgatagaaccctctgtagaaacggataatcatgccgataactcatttaacgcagggctgtttatcgtgaattcactgtataccgctgaaggtgtaatggataaacactcgctgtggcagcgttatgtaccgctggtgcgtcacgaagcattgcgcctgcaggtgcgattgccggcgagcgtggaactggacgatctgctacaagcgggcggcatcgggttattaaatgcggtcgaccgatatgacgctttgcaaggaacggcatttaccacttacgcagtgcagcgtattcgtggggcgatgctggatgaattacgcagccgcgattgggtgccgcgtagcgtccggcgtaatgcccgcgaagtggcgcaggcgatgggacaactggagcaggaactggggcgtaatgcgacggaaaccgaagtggcggaacgtcttggcatccctgttgcggagtatcgtcagatgttgctcgataccaacaacagccaacttttctcttacgatgagtggcgggaagagcatggcgatagcatcgaactggtgactgaagaacatcaacaggaaaacccgttacatcaactgctggagggcgacctgcgacagcgggtaatggatgcgattgaatcgctgccggaacgcgagcaactggtgttaacgctgtattaccaggaagagctcaatctcaaagagattggcgcggtactggaagtcggcgaatcgcgggtcagccagttgcatagtcaggccatcaaacgattacgcaccaaactgggtaagttataggtagcgcatgatcgcacccgaaaagtgccgcacaacatatagactaccaggagttctcatgacggtgcagcaacctaaaaggcggcccttgagccgctatcttaaagactttaaacacagccagacgcattgcgcgcattgtcacaaattgctcgaccgcattacgctggttcgccgtggcaagatcgttaataaaatcgctatttcacagctggatatgctacttgacgacgctgcctggcagcgggagcagaaggagtgggtggcgttgtgtcgcttttgcggcgatttgcactgcaaaaagcagagtgattttttcgatattatcggtttcaagcagtatttgtttgaacaaaccgagatgagccatggcacggtgcgggaatatgtcgtgcgtttacgacgtcttggcaattacctcagcgagcaaaacatttcccacgatctgctgcaggacggttttctcgatgaaagcctggcgccatggttgccggaaaccagcaccaataattaccgtatcgcactgcgtaaataccagcaatataaagcgcatcagcagattgcgcccagacagaaatccccctttaccgccagttctgatatatattaaaaaagcataagatgtagcagagtcgtgttggtgaaacgtggcaaaccttctacattaggctgagtcccccaaaggttcgcgagacgtgacgatgcgccatggcgggacacagtctatggtcattaacggcaatattcggggttactatgaaattagcactgctgggacgtcaggcactgatgggagtaatggctgtagcgctggtggcgggaatgagcgcgaagagctttgccgatgagggtttgctgaacaaagttaaagaacgcggcacgctgctggtagggctggaaggtacctatccgccgtttagctttcagggcgacgacggcaaattaaccggttttgaagtcgatttcgccgaggcgttggcaaaacatctgggcgttaaagcgtcgttgaagccgaccaaatgggacggaatgctggcgtcgctggactctaaacgcattgatgtagtgataaaccaggtcacgatttcagacgtccgcaagaaaaaatatgatttctctacgccttatactgtctccggcgttcaggcgctggtgaaaaaaggcaatgaaggcacgatcaaaacggcggccgatctgcagggcaaaaaagtcggcgttgggctggggactaactatgaagagtggctacgtcaacatgttcagggcgtggatatccgcacctatgacgatgatcctacaaaatatcaggatctgcgcgtaggccgtattgacgcgattttagtcgatcgtctggcggcgttggatctggtgaaaaaaaccaaaggtacgctggccgtcaccggtgatgcgttttcgcgtcaggagtccggcgttgcgttacgtaaaggcaacgaagatttgctgaaggcggtagataatgccattgcggaaatgcaaaaagatggcaccttaaaagcgctctccgaaaaatggtttggcgctgacgtgacccaataatgctctacgttgcccggcaggtagtgcgccgccgggcaatatcaacctcatactatgtcagcaaacggaggcgcgtgaatcggcgccttttttatttccattagatcaacgtgcataataaaaagaacacaccacaacgttaccggaggctcaatgccactacatcacttaacgcgctttcctcgcctggagcttattggcgcgccgaccccgctcgaatacctgccgcgattgtctgattatcttggccgtgagatttacattaagcgcgatgacgttacgcccattgcaatgggcggcaataaactgcgtaagctggagtttctagtggccgacgcgctgcgagaaggggcggatacgctgataaccgcaggggcgattcagtcaaaccatgtccgtcagacggcggcggttgcggccaaattggggctgcattgcgtcgccttgctggaaaatccaatcggtaccaccgcggaaaattacctgacgaatggtaatcgcctgttactggatttatttaatacacaaattgagatgtgcgatgcgctaaccgatccggatgcgcagctgcaaacgctggcgacgcgcattgaagcgcaagggttcaggccctatgtgattccggtcggcggctccagcgcgttgggcgcaatgggatacgtagagagcgccctggagatcgtccagcagtgtgaagaggtcgtcgggctctcttcggtggtggtggcctccggcagcgccggaacgcacgccgggttagctgtcgggctggaacatctgatgccggatgtcgaactgattggcgtgaccgtttcacgttctgtcgccgagcagaaacccaaagtgattgccttgcagcaggctattgccggccagctggcgctgacggcgacggcggatattcatttatgggatgactattttgccccgggttacggcgtgccaaatgacgcggggatggaggcggtgaaactgctggcgaacctggagggggtgctgctggatccggtatataccggtaaagcgatggcgggtctgatagatggcatcagccagaaacgctttaacgatgacgggccgattctctttattcataccggtggggcgcctgcgctgtttgcctaccatcctcatgtataacctccaggtaatcaacgcgaatgcaagaaagtatccaactggttattgaatcgctgccgtatttgcttaaaggcgccgtctttaccctgcaactgagtattggcggtatgttttttggtctgctgctgggatttgtgctggcgctgatgcggatgtctccgctatggccggttcgctggctggcgcgcttttatatctcgatttttcgcggtacgccgcttatcgcccagttatttatgatctattacggcctgccgcaatttggtattgagctggaccctatcccggcggcgatgattggtttatcgctcaataccgcggcttacacgtccgagacgctgcgcgcggcgatctcggctatcgacaagggacaatgggaagcggcggcgagcattggcatgacgccgtggcaaacgctacgccgcgctattttgccgcaggcggcccgcgtcgcgcttccgccgttgagcaacagctttatcagcctggtgaaagatacatcgctcgccgcgacgattcaggtgccggagttgttccgccaggcgcagttaattacctcgcgaacgctggaggtgtttaccatgtatctggccgcgtcgttaatctactgggtaatggcgaccgtcttatcggcactgcaaaactatttcgaaaaccagcttaaccgccaggagagagagccaaaatgagtgctatcgaagtcaccaacctggtcaaaaaatttcatggtcaaacggtgctgcacggtatcgaccttgaggtgaagcccggagaagtcgtcgccattatcggcccgagcggctcagggaagacaacgttattacgctgtattaacctgctggaacaaccggaagcgggcaccattaaagtaggcgatattatcatcgataccgcccgcccattcagccagcaaaaagggttgattcgccagctacgtcagcatgtcggctttgtctttcagagttttaacctgttcccgcatcgtaccgtgctggaaaatatcattgaaggtccggtgattgtaaagggagagccgaaagctgaggcgacggcgctggcgcgggaactgttagccaaagtcgggttggccggtaaagagacccgttatccgcgccgcctgtcgggcgggcaacagcagcgcgtggcgattgcgcgcgcgctggcgatgcgcccggaagtgattctgtttgatgagccgacgtctgcgcttgatcctgaattagtcggcgaggtgcttaatacgattcgccagctggcgcaggaaaagcgcacgatggtgatcgtcactcacgaaatgggctttgcgcgtgacgtggctgaccgggcaatatttatggatcaggggcaaatcgtcgaacaggggccggcgaaaaccttgttcgccgatcctcagcatccgcgtactcgccagttccttgagaaatttttagtgaaataataccttttcaacgctcgcccgaattagccgtgcctcgggcgagcgcaatgaataattatgaagtcattctgccagattattaacctcgctctttggcggaagtcgaaaaactgtaatgccgctcaagtattctatgattcgtccgatattccttatatataaacaccatttatgtgttaatttaagtcattcataataatgattatcaatatcaaaggcgtgaccataaaatatgcaggaaaatgatttcttcacctggcgacgcgcaatgttgttacgctttcaggagatggcggcagcagaggatgtttatactgaattgcaatatcagacacagcggctggaatttgattattatgccctgtgtgttcgtcatcccgttccctttacccggcctaaaatatcgcttcgtaccacttatcctcaggcgtgggtaacgcattatcagtccgaaaactatttcgcgattgatccggtattaaagccggaaaatttcaggcagggtcatttacattgggatgacgtgctatttcatgaagcgcaggcgatgtgggatgccgcccagcgtttcggattacgcagaggcgtaacccagtgtgtgatgttgccgaaccgggcgctgggctttttatctttctcccgtagcagtttacgctgctcctcgtttacctacgatgaagtggagctgaggttgcaactgctggcgcgggagagtctttcggcgctgacaagacttgaagacgacatggtgatggcgcctgagatgcgtttcagtaaacgtgagaaagagattctgaagtggacggcggaagggaagacctcatcggagatcgccattattctgtcgatttctgaaaataccgttaacttccatcagaaaaacatgcagaagaaattcaatgcgccaaataaaacacagattgcctgctacgctgcggcgacaggtctgatatgacgtgctgacgatgcttcgcgccagacgcgaaaccggctgaaagcgatgctaacagccggttttttactactggcggtaagcctgtttaatttgcttaaccgtactggaaaataccgccgcttgtgcttcatcatccatctgcgcgatctgtttttccattttaagaatcacgcgccctgcatcggcctggcccatcgcctgcagcatcagcgttaacatggctttcaggcagttgacttcagtagccagttcttgattattctcagcggtggaaaaatcaggcgtactcatttattttcctcgttatgtttcagtgaaaatgtgcgatagcagatgttaaggcggcggagtataccataagctacgctaaaaatagcagtggttgttttttgatcaaaaagcagaggggttacccacaaaataaacgttgccgcgtgatgcatatattttcttcattctttgtttattacgcgtattttactcgttaattattgttacaaagttgattccctaattagtgtttagacagcggaacgtgaaatttttgtcaccattatgaaatagcagcccggaacagcgccgtcagaaggggctacaacgttggcagttgccacatgacgtacaacataatttccaaaaacgagagcaaaatcgaatacccggtgtttttttacgtttcaaagttgagataaaaccagctaatataagggcgattaactatcagtagcgttatccctattctggagatattcctttgatcaacgttcttcttgttgatgaccacgaactggtgcgcgcagggatacgacgcattcttgaagatataaagggcattaaagttgtcggtgaagcgtgctgcggagaggatgcggtaaaatggtgccgtactaacgccgttgacgtcgtgctgatggatatgaacatgcccggtattggcggccttgaggcgacgcgtaaaattgcccgatcgacagcggatatcaaagtgatcatgctgaccgtccatacggagaacccgttgcccgccaaagtgatgcaggctggcgcagctggctatctcagcaaaggcgctgcgcctcaggaggtggtgagcgctattcgttcggtgtattccggacaacgttatatcgcctccgatatcgctcaacagatggcgctcagtcagattgagcctgcaaaaacggaaacgccgttcgccagtttgtctgaacgcgagttgcagattatgctgatgatcaccaagggccagaaggtcaatgagatttcagaacagctgaatctcagtcctaaaacggtgaacagctatcgctatcgtatgttcagtaaattaaacattcatggtgatgttgagctgactcacctggcaatccgccatggcctgtgtaatgcggagacgttaacaagccagtgagtgaaatatttgacgcaaaggcgttcctgaaaaccgttaccagccaacccggtgtctatcgtatgtatgacgccggcggtacggttatctatgttggtaaagcaaaagacctgaaaaagcgtctttccagctactttcgcagcaacctggcttcgcgtaaaaccgaagcgctagttgcgcaaattcaacacattgatgtcacggtaacgcataccgaaacggaagcgctgctgcttgagcataattacatcaagttgtatcaaccgcgttacaacgtgttgttgcgtgatgataaatcctatccttttatttttctgagcggcgatacccatccgcgtctggcgatgcaccgtggcgccaaacatgcgaaaggcgagtacttcggtccatttcctaatggctatgccgttagggaaacgctggcgctgttacagaaaattttccctatccgccagtgcgaaaacagcgtgtatcgcaaccgctcgcgtccttgcctgcaataccagattggccgctgcttaggcccctgcgttgcaggactggtcagcgaggaggagtacacgcaacaggtggagtatgtccggttgtttttgtccggcaaggacgaccaggtcttaacacagctgattgcccggatggaaaaggccagccaggatttggcatttgaagaggcggcgcgtattcgcgatcagatccaggcggtacgccgggtcacggagaaacagtttgtctccaatgcgggcgacgatctcgacgttatcggtgtggcttttgatgcgggtatggcctgtgtgcatgtgttgtttattcgccagggtaaggtactgggcagccgcagctattttccaaaagtgcctggcggtacggaactgggcgaagtggtggaaacctttgtcgggcagttttacctgcagggtagccagatgcgcacgctaccgggcgagatactactcgattttaatctgagcgataaaacgctgctggccgattcgttgtcggagcttgccggacggcgtattcatgtccagacaaaaccgcgcggcgatcgcgcccgctatctcaagctagcgcggaccaacgcggcaacggccttagtcactaaactttcgcagcagtccaccatcacgcagcgtttgaccgcgctggcgacggtattaaaacttcctgcgatcaagcggatggaatgttttgacatcagccataccatgggggagcaaacggtcgcatcctgtgtggtatttgacgctaacgggccgttacgcgccgagtatcgtcgttataatatcgcgggcatcacgccgggtgatgactacgcggcgatgaatcaggtgctacgtcggcgttatggcaaggccatagaagaaagtaagattccggatgttattctgatcgacggcggaaaagggcagctcgcccaggcgaaagccgttttcgctgagctggatgtcccctgggataagcatcgtcctttgctgctcggcgtcgccaaaggcgcggacagaaaagccggtctggaaacactcttttttgaaccggaaggcgaggggtttagcctgccgccggactcgccggcgctgcatgttattcagcatattcgcgatgagtcgcacgatcacgcgatcggcgggcaccgtaaaaaacgcgcgaaggttaaaaataccagtacgctggaaactattgaaggcgttgggcctaaacgtcgccagatgctgctgaaatatatgggcggtttgcaaggattacgtaacgccagcgtagaagaaattgcaaaagtgccgggtatttcgcaaggtctggcagaaaagatcttctggtcgttgaaacattgaggccactgtagcaacataggggtaatttcactgacaacagatagttacccgtcactatgcaatttaatatccctacgttgctcacgctgtttcgcgtcatcctgattccattctttgtcgtggtgttttatttgccgttcgcctgggcgccgatggtcagcgcgctgattttctgtattgccgcgattaccgactggtttgacggctttctggcgcgacgctggaaccagagtacgcgtttcggcgctttcctcgaccccgtcgccgacaaggtgctggtggcgatcgccatggtgctggtcaccgagcattatcatagctggtgggtgacgttacctgcggcgacgatgatcgcccgcgaaattattatctctgctctgcgtgaatggatggcggagctgggcaaacgcagtagtgtagcggtctcctggatcggtaaagtcaaaactaccgcgcagatggtggcgctggcgtggctcttgtggcgtccgaatatctgggtagagtatgccgggatcgcgcttttctttgtcgcagcggtgctaacattgtggtccatgttgcaatatttgagcgctgcacgcggagatttgcttgatcagtgatcgtttcgccgcaaatttcagcaaacgatcgtgagtgacgaaaaatatcgttgactcagtgcgtcaggtaagtagaatgcaacgcatcggacggcagcactgattgccagacgataacaaaatcaagcgattaacaaagttgcttgatactgcgggaatagctcagttggtagagcacgaccttgccaaggtcggggtcgcgagttcgagtctcgtttcccgctccagtttaaaagcattggcgtaaagcggatgctggctgaaaagccaaaaaaatttggcgcgttaacaaagcggttatgtagcggattgcaaatccgtctagtccggttcgactccggaacgcgcctccaatttttcccgagcccggatggtggaatcggtagacacaagggatttaaaatccctcggcgttcgcgctgtgcgggttcaagtcccgctccgggtaccatgggaaagacaagaataatcaaagcaataagcagtgtcgtgaaaccacctacgggtggtttttttgtgctttcagtttgtatgccgaccgcgagcgtgaactctccagcgcgatacacagtaaaaaacatcggtagcggcatttctgccagtacaacagttatgtgctaccgacccgcaagaacttatgcctggtaaatactaaacgtcgggtaaatcagccgataaaatccattaatctctataaaaaatgctgatatgttttatgcctgctttattaaagagagtaggtctgccagtgaaatataccgataatgcaaaattatttattagcttcattaatattgggattgtaagttgcgctttgctacttttttattttgtatgagcctgagagtgcaatcgtaacctactctcttcccggtgagctttcctcttcgacatgtgatgcacataattttattggctacgtcgatgcaaatgactttgcagagtatataaaaaaagtagaactgacgcgctacaatatgtattgtctgaaaaaaacaggggcaggccagtggagtatttatgcaaattaaacgagtatataactgttcaggggtattttctgcacaatttaattaaaggtagatagcgaactaatattcatcactaggtaatgtgatccgcttcatgctttaatcacgttttgcaatattgtcttaataacaggtcaactacagataatttcgggttttcgtgaatggcggttttggtcagtctctatattatgctttccccgctttacggagatgatgatgcaaaagaaaacctgggccgttttattgataccattgtgcctcaccgcttgccaccagacgaccaaccgatcaacagccaaagatgaaattctcacagggagctatattgacccgacaaaaacacgctttccgttagcggattattcacagtcggttgataaatggatacctccggactcggctgattacactattccggttattgatagtgctacccaacaacgctactttagcgcactaaaatctcattatttcggaatggacagtgaagcgcactcgccgtggaatgatttttatattaccgcattgctgaaaaaaaacgcagcacaggcccgggatgccagtattaagcagtttcttagcgacggcagtgcttattggggggaaaacttcagactttatacctctcgctggaaagaggaggttagagggaatacggatacgcagattgacaatatctatcatgcctcccggcgaggcattatggtcagagaaagtttagtcagagcgctgccaacggacgacccgctctttaacgatccccgtcaggcgggcgaggggtacccgtttgataatttacaaatgtcttcgctgcgtcccggtacgccggtctatacgctgacgaagagcaaagaccaacgctggcaatatgtcgtttcaccagcggtaactggctgggttcacagtgaagatattgccagtacggatcagaaatttataacacagtgggttttgctcgctcacaagcaactgggggcatttatcaacgcgccggtttctgtccatgccgcaggcgtctattatttcaccgggcgaccgggtactattttaccgttccgacatcaacgggcgggccagttcctgattgcggcgccagttcgcggcagcaacggtcgcgcgtttatccattgggtctggctaagcggtaacgagtttacggctatgccgtggaaaatgacgccggaaaatatcgccgtgctaatgaaagcaatgcacggcgccccctacggttggggaaattttaacttttataatgattgttcagccgaagtccgcagcctgttaatgccgtttggcatattcctgcccagacattcatccgcgcaggtagagtctgctggacgggtggtcgatcttagtcataaaaatccccaaatgcggatcgattatctcaccagatacggaaaagcgtttactacgctggtctatattccagggcatattatgctgtatatcggtaacacaaccatgaatgggcaggtcgtgccgatgacttatcagaatatctggggattgcgcccaaaccatgctaatagccggagcattatcggtgaggcggtatttttgccgttactgcgtttttatcctgaaaatcctgagctgatatcgctggctggtaaggttctgtttaagcttggttatatagaataggttgacaaactgtgttatcgcggaagacatgattaaggcaaccgtgcgcgtggatataaagatagtatccctgtaaactgtgtctgaaaaaagtatacgctatagtgcgggctgtttatttgaaatactatctggagctgattctggatgtgattatgtgcctcacacattgaagtgagagttattgttggcggtatctggctggaggctgggtggtaaaaagacgtaatttattgcattttaataacggtgcccggtcagagcgcgatcttggggatctggtcactaaagtttttgagaaagcggcgaaaaaagaaccgcaaccgctatacacatttagcctgccgttgctgagtgtgcaagatgagatccgtgtttactgtaagaaaaaaatatcaaaatagggtacgatacgctgtttatggaaataaccttttctgctgacagagaagcggtagacgaactcattaaacacttttttactgaaaataagctctatttgagagggcggttttatctgtccgcggcggtggtataagttagcatgagtataatatagcgagaaacctatctctcacttttgtgtggggcgagcgcttcctggcggaaaatctgcgccctgatcctccttttgtgcgttaacttccggaatcctcctcatttcgtgttaatctggcccctgatggttgccatccaaactgcctgcaaaaaaattatttttatccgctgcaatgtaagaggcctacaggcggaagtcatcactgaggaaaagcattatgaaaatggaaccattaaacgagaacgagctggaatggctggatgatgtgctgacgaaatacaataccgatcaggtcattttggatgtcgcggagctggacggtctgattactgcggtactaagttctccgcgtcccatcgagccggaacagtggctggtcgcgatatgggggggacccgcgtacgtaccgcgctggacatctgaaaaagaaatgacgcgatttatggatctggtattccagcacatggcggacacagccgcccggcttgaagactatccagaacagttcgagccgctgtttggcctgcgagaagttgatggccatgaattaacgattgttgaagaatggtgctttggttacatgcgcggagtgtcgctgtccgactggtctgacttgccggatacgctaaaaccggcgctggaagcgattgccttacacggcacggaagaaaactttgcgctgttggataaaatgagcccggaagcgttcgataaaagcgttgacgctatccgtatcgcggcgcttgagctgcatgcctggtggatggcgcatccgcacacgacgccgctacagatgccgataaaagcggaggtgaaagtggggcgtaacgatccttgtccatgcgggagcggcaaaaaatttaagcagtgctgcctgcattaatggctcgtaaacggccatagcgtgatgattatcgagcctggacggcgtccgggcccggtaatctttgcctggcgttaacctggatcgggcaggaaccccagtgcgatcgaaaactggacgccaatcacgacaatgccgcagataaacaccagcgccagcgctggcgtgccgcctgccacacgatatcccgcctgagggctctgtttacggcattgccagaccagcatggcagggatgagtagtgccagcactgccagcgctacgccggcatagcctaatgccatcacaaatccacgtgggtagaaaagcgcaaacgccagcggcggcagaaaggtaatcagcccggtttgcaggcgtccggacaccgtactgcggcgctggaatagatcggccaggtaatcaaataatcctagcgctacgcccagaaaagaggtcgccagcgccagatcggcgaacaggtggaccgccagttcgacatgtggcgaagcgaccacttctctgagcgcctgcagcaggccatttaacccggcatggctggccagtagccctctgaatgtcggcgagtcgatacttcccagcgtggcgagctgccaaaaaatataggccactagcggaatggcgctacccgtcataaagacccaacgcagccggcgaatgttgccgttcatataactcacaatactcggtacgcttccgtgaaaaccaaacgaggtgaaaatgaccggtatggcggacaatgccagcccctgctgtaaaggaagcgtaagaagatttactttatgaatatgtggcgtgagcaacgcaagcatgatgaccagaaaaatgatcttcgcgctaaacaggaagcggttaaaaaggtcgaccagcgaggtgcccacacacaccaccccaccggcaacaaaggtgaacagcagcaccccggcagcgggcgagagcgtggcgccaagccagttattaatactggatgccagtaattctccggctccggaaatgtaggcggcggtgagcgcatacattaagaacatcatgctgaatcccgtaagccactgtccgtaacgtccaagatagcgttttgccaacgagcccagcccggtatccgccggaacatgttgatatacttccagtaatagtagcgcggtataacacatcagcgcccacagaccaatcaacaatcccagcgtgacgctgaaaccaacgccagccgctgccagcggcattgccagcatcccggcgccgatagtggtgcctgccacgataaaaatactgcccagagttctgtttttcacgctttctactaccccggtaacaaagaacggtgatatccgcggcgcagggtaaggcattacgctattttcgtcaaatggtcgttacaataggtgtactggaaattttacagttccgggcataaaagcgaatatgggaggagacgcggacaaccgccgcaaacctgcgctagcgcaaagtcgctcgcacaaggacacattaggctacaagttttattcaggagggcttatggattccattcacggtcacgaagtactcaacatgatgattgagtctggcgagcagtacacgcatacctcgctggaggcggcaataaaagcgcgctttggcgagcgggcacgatttcacacctgttcagcatcagatatgacggcggcggaactggtcgcgtttctggcggcgaaaggaaagtttattgcggtggaggacggtttttcaacgcatgagagtaaaatctgccgccattaatacgccacggtgagagcgcgtctcaccgtgtaaggacgtgctggattaattttgcgtatccagggtggagagttctttatcaatgaaataaagcccttcgccgctttttcccgccagcgttaatttatcaataatagatttgaacagtttttcttcttcatgctgttccgccacataccactgcaagaaattaaatgtcggataatcctggctggtcattgcggcatgagccagttcattaattttttgcgtaataagctgctcatgctcataggtcgcgcggaacagttcatccagtgaggtgtactcagcgaagggcgaagaaacgctattaatgcgcggcaggcttccggtatcggtaaggtagtcaaacaggcgctgcatatgcgtcatctcttcttgcgcatggcgacgaagaaatgcggccgcgccttcaaaactgtgatagctacaccacgcgctcatttgttgatagagcagggaggagtacaactccagattcatttgctcattcagtttgtcgatcatttctgttttcagcatggttccgctccacaaatagcaaaagatatacggtaatgtggcgccactataatttgttattttattatttgcaaaaggtaaaatattaaatttaattattaaaaatacgaatgggaataaaacgcattaacgccagtgtatagcgtataaaaataaaggaaagccagcaccttcatgctggcaatagcgaccctgcactctcctctattgtacatggtgtcggcgttaagccagccgccttaataataaagcggcatgatttgcgggacggaaacgccccggcactgccaggagagggtaaatcgggtgttcagacacaacgagcccgcataaatgctacaggttcctaccggctgaccaaacgaaacggcatcggcatagcccatctgctggcattcgcgtgttgcggttccgtgagatacatagtcatctgtccgtgaagtaaaaaatagcggctggttatacgtcaggcgcacgatgccgcttatcgggctggcttcgctgacctgcgcttgtcgagtaatggtgcatcccgtcagggctagcagtgaaagagtaaaaataagaggcttcataaaatcgctccgacagttcggtatcagaccatgctacctcgtgtcttgcaccgtcaatggctggaataacttacggattcgccttgattaaaggtaacggcaggggatttacagcgggaacagaaaatgtgtgagcgtcttttcatttaatgaaactttgtttcattaaatttgaatgtgtgttcgtaaatgtgtagtgtaggcaaaacgtcatgatttatgcaggcgccacctctggcaaacagaccagaaacggtgtaggccggataagctgcttcgcgttgctatccggctaataacgtctcaatattgtcgctcggggtgccgctatcagtgatgctgataggtcacgacgttaaggagatgctgatcggtttgcgccaggcatagccctgctcgtttagcgctgcgaacttcttcgagaatagtttgtaaaagtacgccatcctgctgctgctctttttccagggtatggagaaaatcgagcgttgaggcatcattcagcgctttcgcttcatctgccagacgcgacagcgtgctggcgcgttgctgataatcctccagggttttctggaacaattcttccagagagcagagctcttcacccggaacgtcaatggctttaacgataggggtggcgccggcgtttttcataaaattaaacatgcgcatcatttgcgtcacgttgccttgcgcttgggtacgaagaaaggtggctgtacctgttaaactgtgttcagaacaccattcgcttagatggaggtaaagatttgatgcgtaaaactcaagattcattggcgtgttgagcttttgaaccattcctacagctgccataacaatatccttatttccagaaagtgttgatgtgcatgacagacgagaatgcaacggatcgttgtcacattcttacctctatgcacaataaatactcttagcagaagaactccgttccgccagtcccttatgcgatctcatttcctgtttatcgatcggtaatgagaatagcgcgtcaatgaaaataagaaaatccttaaatgcaattgtttatctttttttacattttcagctgtgtgattttttcatcagaaatgatttttggtatgtcattcttataactatttgaaagataaaagatattctattttttctggtttatgaaacattgtttcagatcataagataggcctttcaagtatggtaatttcaataaaataaacattagccagtctggatatcacacgcataaacggttgagagcaaatatgcctgtttttataaactagccgattttgcggtagatcatttttaatatcattaatcatacgagcacgttattcggttgagcgcagttttgctgggtgactcgttaacaaggagcagtcaatgaaaaaggtcgcggtgctactggcgccaggatttgaagaagcagaggccattgttactcttgatattctgcgacgtttgcatatcgacgtcgaaacgctggcgtgtgctgaatcacgggcggtggtgagttaccatgatattcctatggttgcggacagcacgctgagtgaacgccagcaggcgctttttgatgcggtagtgctgccgggcggtccgcaggggagcgctaatctggcggctaatccggcggtgatcgctttcgttgcgcgtcatgatgcggcaggcaaattaatttgtcctatctgttccgcggcggcaagggtgctgggtgctcacggattgctgaaggggcgtcgttatgtctgttccggcgacctgtggaaagcggttccggaaggtgtctatgtggatgcgcccgtggttgaagatggtaatttaattagcggcaaagggttgggtcatgtctttgatttcgcgctaaccctttccgccagactgctgggagacgatgcgctggttcgcgaacaagctgaacatatctattatccctggtaatcgttattcacccagggccgtaaggattagctggctgatgttatggattaatgtgctggctttcctgccttttggctgatgaattcgctctgggttatgtcattttccgctaaaactattccagccatcagcatttatctaatgaatgaaagacagtgcaccgttttacgtcttctctaacaagaatcgtttgattttaccctacataaaaaacgctaaagcaggtcaatgaattccctgggttatgagttaatcgttatttctgcgtgcgtattagggggcgttttcctgagaggcggcctcggaaaaatctcatatgtggtggcgagcgtactgatatcaggaacggtggagaacgcgatgaacctgctcaacatttcaccttttgcacagtacgtggttcgcggctgaatccttctggcagcagttatcttcgaccattataagcaaaaagcgaagcgtatgatttgatgaattaacactcaactaaacagtatagcttcacgtcatcgccaaccgctaccccggctggcgatggtctttctaaatggcgagcagcgtcacactgtctatacttacatgactaatgagaccgtttgtgagtctcaatatgatgataaggaggagaccagggtggcagaaccgttaaccgtatcccccgaactcactgcgaactatgcgtatttttttgaccttgatggcacattggcagagataaagcctcatcccgatcaggtagtggtaccgcataaaatccttcagttgttagaccgtctcgcggcgcacaacgcaggggcactggcattgatttcagggcgttcaatgactgagctggatgctttggcgaagccttttcgctttccgctcgctggcgttcacggggcagagcgtcgtgacatcagtggtaaaacccatatcgtgcgccttcctgaagcggtagtccgtgaggtggaggcgttattacgttcgacgcttgcagcgctgcccggaacggagctggagacaaaggggatggcgtttgcgctgcactaccgtcaggctccggaacatgaagcggcgctgttggcgcttgcgcaacacgttacgcagcactggccgcaactggcgttgcagcctggtaaatgtgttgtggaaatcaaacctaagggaactaataaaggcgaagcgattgccgcctttatgcaggaggcgccctttacgggacggattcccgtttttgtgggcgacgatttgaccgatgaggctggctttggcgtggtgaatcacgctggcggaatttccgtaaaagtgggcgtcggggcaacccaggcggcatggcggctggaaagcgtacccgatgtctggcgctggctggaacaaatcaattatccacaacaagaacaacaagtaatgaataacaggagagatggctatgagtcgtttagtcgtagtatctaatcgaattgcccccccggataataaaggcggcgccggcggcctcgctgttggcgtgcttggcgcgctaaaagcggctggcgggttgtggttcggctggagtggcgagacaggtaacgaggatgagccattaaaaaaggtgacaaaaggtaatattacctgggcatcgtttaacctgagtgaacaagattacgaagattattactgtcaattttccaatgcggttctctggccagcgttccactatcgtctggacctggtacagtttcagcgtcctgcatgggaaggctatatgcgggtgaatgcgttattagcggataagttattgcccctcattaaagagaacgacatcatttgggtgcatgactaccacctgttaccgtttgccagcgagctgcgtaaacgcggcgtgaacaaccgaattggttttttcctgcatattccattcccgaccccggagatttttaacgctttaccgccacatgatgaactgctggagcagttgtgtgactttgatctgctcgggttccagaccgaaaatgatcgcctggcttttctggatagcctttcgagtcaaacgcgagtcacgactcgcagcggcaagcagcatatcgcgtggggtaaagacttccagacagaagtgtatcctatcggtattgagcccgatgagattgctctgcaggctgccgggccgttgccgccaaaactggcgcagctcaaggcggaactgaaaaatgtgaagaatattttttccgttgagcggctggattattcgaaagggctgccggaacgttttctggcgtatgaagcgctactggaaaactatccgcagcatcggggaaaaattcgttatacccaaattgcgcctacgtcacgcggcgaagtacaggcatatcaggatattcgccaccagcttgagacagaagcaggccggattaatgggaaatatggacaattgggctggacgccgctctattatctgaatcagcatttcgaccgtaaactgttaatgaagatattccgttattcagacgtcgggctcgtcaccccgttgcgtgacgggatgaacctggtggcgaaagagtttgtcgccgcgcaggaccccgctaatcctggcgtactggtactgtcacagtttgccggcgcggcgaatgaactgacgtcggcgttaatcgtcaatccttacgatcgggatgacgtggcggcggcgctcaatcgtgcgttaacgatgccccttgccgagcgtatttcgcgtcatgcggaaatgctggacgtgatcgttaaaaatgacattaaccgctggcaggagcgttttattcatgacctaaaggaggtcacgccgcgtagccctgagcgtcagcagcagaacaacgtggcgacgttccctaagctggcctgagatatcgcgagcggcgactagtcgcccgctaacggcaccagcaacacatctacctggctggcgctgacgacacttttgccgagcaggacgcgcgcgaaaagaaactgtggttatggttgccgcaaatgaccagatcaacatggtgtttgcggcacacagccaaaatatgctggcttaactcacctgatgcgatgaaagtttgttcaatcggataatccgccttttcccccagcattttaagaaaattctcggtctcttcatgcataaccgcgcgtaaatcctccatcatgggcgcggcgaactggttatacagttcaggatcggaagcgagagtaatcaggcttactttcgcctgaacagggcgggcgatagagaccgctttagccagtagctggtgactttccggggtgacggcaacggcgacaagaatatgggtgtagctcataactcgctccttgattgcaagaatatgagattgtgctttagctttactctgtttatcgcatttctgcaatgcgctaatgccacattaatgtgaaggacatcataattaatcattgattattcttatgtaaagaatcgtggcataagacactttttacacaccaccaggatgctttatttaaacgggtgaacaaggaaagctaaaagttaaatcaaatgagcttatttttaacagaggagggcgtatgctgtgacgagattaattaataacgtttaatatttaagccactgtttactaaaggtaaaataaaattgtttctaaaatagaaataatagcctgttatctattatcctggcgttattttaacagagagaaacaaaaaagaatttggtgttgacgtacccctattcagcagtgtggaatagaaaaagtgaatattaggttattaattaaacaaagtaaaagccatactgatggttttatcgtaagtattctgttaaattatgtgatctgcatcgcatattttctaaaatcgccgtcccgctccgttgtatgtcacgaaactgacgagtagagttgcgtcgaattaggaaaaatcttaggcatttgtaaaaattgatgtaaacgtgtaaggcgaatcccagtgggaagctgcgttatacgtcacaatgtccataatgtctgagcgctgctatgcatttgacctttttgcttcttttaccgggccttcccggcgacatcacggggtgcggctacgtcgcacaaaaataaagttggttattctggatgggaacaatgcatacatccgagttgctaaaacacatttatgacatcaatttgtcatatttactccttgcacagcgtttgatcgtccaggataaagcatctgcgatgttccgcctcggtatcaacgaagagatggcaaacacactgggcgcgttgaccctgccgcagatggtcaaactggcggagacgaaccagttagtttgtcatttccggtttgacgatcatcagacgatcacccgtttgactcaggattcgcgcgtcgatgacttacagcagattcacacaggtatcatgctttcaacgcgtctgctcaatgaagtggacgatacggcgcgtaagaaaagggcatgataatgagcgaaaaaagcattgttcaggaagctcgcgatatccagttggcgatggagttgattaatcttggcgctcgtctacaaatgctggaaagcgaaacacagctcagccgtggtcgcctcatcaggctgtacaaagaattacgcggtagcccgccgcctaaagggatgctgccattttcgacagactggtttatgacctgggagcaaaatattcatgcctccatgttctgcaacgcctggcaatttttactgaagaccggcttatgcagcggtgtggatgcggtgattaaagcttatcggctttatcttgagcagtgtccgcaaccgcctgaagggtcgttgttggcgctgactcgcgcatggacgctggtgcgttttgttgaaagtgggttgcttgaattgtcgagctgtaactgctgcggtgggaactttattacccatgcgcatcagcccgtaggcagctttgcgtgtagtttatgccagccgccatcccgcgcagtaaaaagacgtaaactttcccgagatgctgccgatattattccacaactgctggatgaacagatcgaacaggctgtttaaccgaaacggtgtggacaaacactccagcagcggtaagccattaccgctgctttttttttttgccttgccttcgcgttaatcgcccgactgcgcatcctgtcatagtcaacagcggaaggatgatgtcgtgcttatcttattaggttacttggtggttatcggtacagttttcggcggttatgtcatgaccggcggacaccttggggcactctatcaacctgctgaactggtcatcattggcggcgcggggatgggggcgttcattgtcggcaacaacgggaaggccatcaaaggcacgatgaaagcgatcccgttgttatttcgccgttcgaaatacacgaaatctatgtacatggatttgctggcgttgctctatcgcctgatggccaaatcacgccagcaggggatgttctcccttgaacgcgatattgaaaatccgaaagagagtgaaatcttcgccagttatccgcgtattctggccgatgcggtaatgcttgattttattgtcgattatctgcgtctgatcatcagcggcaacatgaatacgttcgaaattgaagcgttgatggatgaagagattgaaacccatgaaagcgaggcggaagtcccggccaacagtctggcgatggtgggggattcgctgcctgcctttggtatcgtcgcggcggtaatgggggtggttcacgctctggcttcagccgatcgtccggcagcggagttgggggcgctgattgcccatgccatggtaggtacgttcctcggtattttactggcttatggattcatttcaccgttagcgaccgttttgcgccagaagagcgccgaaaccactaagatgatgcagtgcgtaaaaattacactgctgtctaatctgaacggctatgcgccgccgattgccgtggaatttggtcgtaaaacgctttattccagtgagcgtccatcgtttattgagttggaagaacacgttcgcgcagtgagaaacccaaaccagcagcagacgactgaggaagcatgaaaaatcaggctcatcccattgtcgtcgtaaaacgccgcaggcacaaaccgcacggcggcggggcgcacggttcctggaaaattgcctacgccgattttatgacggcgatgatggctttttttctggtgatgtggctgatttccatctccagccctaaagaattaattcagattgccgaatattttcgtacgccgttggccaccgcggtaacggggggaaatcggattgccaatagcaagagcccgataccaggcggcggcgatgattacacccaacagcagggtgaagtggaaaagcagccgaatatcgacgagctgaaaaaacggatggagcagagtcggttaaacaaactgcgcggcgatctggatcaactgatcgaatccgatcccaaactgcgcgcgttacgtccgcatctgaaaattgatttagttcaggaggggttgcgcatccagattatcgacagccagaaccgcccgatgtttaaaaccggcagcgccgaagttgagccgtatatgcgcgatatcctgcgtgcgattgcgccagtgttaaacggtatacctaatcgcattagcctggccggccataccgatgactttccctacgcgaacggcgaaaaaggctatagcaactgggagttatccgccgatcgcgccaatgcctctcgtcgcgaactggtcgctggcgggctggataacggaaaagtattacgggtggttggcatggccgccacgatgcggctgagcgatcgcggtcctgatgacgccatcaaccgccgtataagcctgctggtgttaaacaaacaggcggaacaggccattttgcatgaaaacgctgaaagccagaatgagccggtaagtgtattacaacagcctgcggcagccccgccggcaagcgtacccacatcgccaaaagcggaaccgaggtgatagcgtgagcatggatattagcgatttttatcagacattttttgatgaagctgacgagctgttggctgatatggagcagcatctgctggatttggtgccggaatccccggacgctgaacaactgaacgccatttttcgcgcggcgcactccattaaaggcggcgcgggcacattcggcttcactattctgcaggaaaccacacatttaatggaaaacctgctggatgaagcccgacgcggtgaaatgcagctcaataccgacattatcaacctgtttttggaaacgaaagatattatgcaggaacagctcgacgcctataaaaactccgaagagccggatgccgcaagcttcgaatatatctgcaatgcgctacgccagttggcgctggaggcgaaaggcgaaaccacgccggcggtcgtagaaaccgcggcactaagtgcggcgatccaggaagagagcgtagccgaaaccgaatcgcctcgtgacgagagtaaactgcgcattgtactttcacggttgaaagccaatgaggtcgatctgcttgaagaagagttgggcaatctggctactctgacggatgtcgttaagggggcggattcactgtcggcaactctggatggcagcgtcgcggaagatgacattgtcgcggtgctctgttttgtcatcgaggccgatcagatcgcttttgaaaaagtggtcaccgcgccggttgaaaaagcgcaagagaaaaccgaggtagcaccggtagcgtctccggcagtcgttgcgccagccgccaaaagcgcggcccatgaacatcatgcggggcgtgaaaaacctgcgcgtgaacgcgagtccaccagcattcgcgtggcggtagagaaagtggatcagctcataaacctggtcggcgagttagtgattacccagtcaatgttggcccagcgttctaacgagctggacccggtaaaccacggcgatctcattaccagtatggggcagttacaacgtaacgcccgcgacttacaagagtcggtgatgtcgattcgtatgatgcctatggagtacgtcttcagccgtttcccgcgtctggtacgcgatttagcgggcaaactgggcaagcaggtagagctgacgctggtggggagctccactgaacttgataaaagcctgatcgaacgcattatcgacccgctgacgcacctggtgcgcaacagtctcgaccacgggattgaaatgccggaaaaacgccttgaggcggggaaaaatgttgtcggcaatctgatcctttctgcagaacatcagggcgggaatatttgtattgaagtgaccgatgacggcgcggggcttaaccgtgagcgtatcctggcgaaggccatgtcgcaggggatggcggtgaatgaaaacatgaccgacgatgaagtaggcatgttgatcttcgcgccgggattctcaactgcggaacaggtcacggatgtctccggtcgcggcgttggcatggatgtggtgaaacgtaacattcaggagatgggcggtcacgttgagatccagtcaaaacaaggctccggcaccacgattcgtattctgctgccgctgacgctggccatcctcgatgggatgtcggttcgcgtggcgggggaagtttttatcctgccgttaaatgcggtgatggagtcgctgcaaccgcgtgaagaggatcttcatccgctggcgggcggcgaacgggttctggaagttcgcggcgagtatttgccgctggtcgaattgtggaaagtgtttgacgtggacggggcgaaaaccgaatccacgcagggcattgttgtgatcctgcaaagcgcgggacgccgttacgcgctgctggtcgatcagctcatcggtcagcaccaggtggtggtcaaaaatctggaaagcaattatcgcaaggtaccggggatttccgccgcgacgatcctgggcgacggcagcgtcgcgctgattgttgatgtttccgcattgcagggtttaaaccgcgaacaacgtatggcgatcacagccgcctgattgagtgagaagggaataatatgaccggtatgagtaatgtaagcaaactggccggcgagccgtcaggtcaggaattcctggtgtttacactgggaaatgaagagtacggcatcgatatcctgaaagtgcaggagatccgtggctatgaccaggtgacgcgcatcgccaatacaccggcctttataaaaggggtgactaacctgcgcggcgtgattgtccccattgtcgatctgcgcgtgaaattctgcgaaggcgacgttgagtatgatgacaatacggtagtgatcgtactgaatctggggcaacgtgtcgtcgggatagtggtaggcggcgtgtctgacgtactgtcgttaacggcggaacagatccgtccggcgccagaatttgccgtgaccttgtcaacagaatatttgacgggattgggcgcgctcggcgagcgtatgctgattctggtgaatatcgaaaaactgcttaacagcgaagagatggcgctgctggatatcgcagcatcacacgtcgcgtaataacgttgccggatggcgtcgcgccatccggcaatattcaccgttatgcttccgccagcggtgagagtgcctcttcatcgcccgcgcccagcccctgcattttgcgccggcatcgccgctgcgacactgtcattggcaatgtcgtcttccggaacagcgtatttcctttttgcaaaagtaaagttatcaccgcaggtgccgataacgttgataactcgttatcaggaaggtgccttatgtttaaccgtatccgcgttgtcacaatgctgatgatggtgctgggggttttcgcactgctacagcttgtttccggtggtttgctgttttcttcattacagcataaccagcaaggttttgttatttctaacgaattacgccagcaacaaagcgaactcacgtcgacatgggacttaatgctgcaaacgcgcattaacctgagccgctccgccgcacgcatgatgatggacgcttctaaccagcagagcagcgccaaaacggatttactccagaatgcaaaaacgaccctcgcacaggcggcggcgcactacgccaatttcaaaaacatgacgccattgccagcgatggcggaggccagcgcgaacgtcgatgaaaaatatcagcgctatcaggccgcattagccgaacttattcagtttctggacaatggcaatatggatgcctacttcgcccagccaacccagggaatgcaaaacgcgttgggcgaggcgctgggcaattacgcccgggtgagcgaaaacctgtaccgccagacatttgatcaaagtgctcatgactaccgttttgcgcaatggcaactgggggttcttgcggtcgtgctggtgctgattttgatggtggtttggttcggcattcgtcatgccttgcttaacccattagcgcgagtgattactcatatccgtgaaattgccagcggcgatctgacgaaaacgctcaccgtctcaggacgtaatgaaattggcgaactggcgggaacggttgaacatatgcaacgctcgctgattgacaccgtgacgcaggtttgtgaaggttcggatgcgatttattccggcaccagtgaaattgccgccggtaataccgacctctcttcccgtaccgaacaacaagcctccgctctggaggagacggcggccagcatggaacaactgacggccaccgtgaagcaaaacgccgataatgcccgtcaggcttcgcaactggcgcaaagcgcctccgagaccgcgcgtcatggcggcaaagtggtcgacggcgtagtaaacactatgcacgaaattgccgacagttcgaaaaaaatcgctgacattatcagcgttatcgacggtattgccttccagactaacattctggcgctgaacgcggcggtagaagcggcgcgcgcgggagagcaggggcgcggttttgcggtcgtggcaggcgaggtgcgtaatctggccagccgcagtgcccaggcggcgaaagaaataaaagcgttgattgaagattccgtctcgcgtgtcgataccggttcagtgctggtggaaagcgccggggaaaccatgactgacatcgtcaatgccgttacgcgcgtcacggatatcatgggcgaaatcgcctccgcctcggatgagcaaagccggggtatcgatcaggtcgctttggccgtttccgaaatggatcgcgtaacgcaacagaacgcctcgctggttcaggaatccgcagcggccgccgccgcgctggaagagcaggccagccgtctgacccaggcggtatcggctttccgcctggcatcgcgaccgctggcggtaaataaacctgagatgcgtttatcagtggacgctcagtccggcaatacgccgcggcccttagccgccggggatgatgcgaactgggaaaccttctgatcgatgtgcgctgtgtgctgtcggttatcgattaatttgcgaacccgccgatccctttcgtctggttcgcatagataaaagcaaaaaatgtgtaatacgggaagcatggcgctgccgcagggcgcgcccgttgtactttgaatgtgattaagaaggcgctatgacatcatctctgccctccgggcaaacgtcagtattgttacagatgacacagcgcctcgcgctgtccgacgcgcattttcgtcggatatgtcaattaatctaccagcgtgcagggatcgtgctggccgaccataagcgggatatggtttataaccgcctggtccgtcggctgcgtgccctgggactggatgattttggccgttatctcagtatgctggaggctaatcaaaacagcgttgagtggcaggcttttatcaacgctctgactaccaacctgaccgctttttttcgcgaggcgcaccattttcccatccttgcggaacatgcgcgtcgccgccacggcgagtaccgcgtctggagtgcggcggcatcgacaggagaagaaccttacagtatcgccattacgctggcggatgcgttagggatggcccccggtcgctggaaagtattcgccagcgatattgatactgaagtgctggaaaaagcgagaagcggtatttatcgcctcagcgaactgaaaacgttatcgccgcagcagctacaacgttacttcatgcgcggtacggggccgcatgaaggactggtgcgcgtgcgtcagcaactggccaattatgttgaattttcctccgttaatttattggaaaagcagtacaacgtacccggtccctttgacgcgattttttgccgtaacgtcatgatctattttgataaaacgactcaggaggacattctgcgccgttttgttccactccttaaacctgacggactgttgtttgccggtcactcagaaaactttagcaacctcgtgcgcgagtttagcctgcgcggacagacggtgtatgcgctaagtaaggataaagcatgagtaaaatcagggtattgtcagttgatgattccgcgctaatgcgccaaatcatgactgaaattattaatagccatagcgatatggagatggtagcgactgcgccggacccgttggtcgccagggatctcatcaaaaaatttaatccggacgtattgaccttggacgttgagatgccgcgtatggacggcctcgattttctggaaaaactgatgcgcctgcgaccgatgccggtggtgatggtctcttcgctgaccgggaaaggttccgaagtgacgctacgggcgctggagttgggggccatcgattttgtcaccaaaccgcagcttggcattcgtgaaggtatgctggcgtatagcgagatgattgccgaaaaagtgcgtaccgccgcgcgggcccgcatcgccgcacataaaccgatggcggccccgacaaccttaaaagccggtccgctgctcagttcggaaaaactgattgctatcggcgcttcaacgggcggtactgaagctatccgacatgtgctgcaaccgctgccgctttccagtccggcagtgattattacgcagcatatgccgcctggctttacccgctcgtttgccgagcgcctgaataaactctgtcaaatcagcgtgaaggaggcggaggacggcgaacgcgtattgccaggtcatgcctacattgcgcccggcgacaagcatatggagctggcgcgtagcggggcgaattatcaaatcaaaattcatgatggcccgccggtaaaccggcatcggccttccgtggatgtgctgtttcattcggtggcgaaacacgcggggcgcaacgccgtaggcgtcattcttacggggatgggcaacgatggcgccgctggaatgttagcgatgtaccaggctggcgcctggaccattgcgcaaaacgaagcaagttgtgtggtgttcggcatgccgcgcgaggccatcaatatgggtggcgtaagcgaagtggtcgatcttagccaggtaagccagcagatgctggcgaaaatcagtgccggacaggcgatacgtatttgaaccaggagtagtattttatggcggataaagagcttaaatttttggttgtggatgacttttcgaccatgcgtcgtatcgtgcgcaacctcttaaaagagcttggatttaacaatgtggaagaggccgaagacggcgtcgatgcgctgaacaagctccaggcaggcggctttggttttattatctctgactggaacatgccgaacatggatggcctggagctgctgaaaaccattcgcgccgatagcgccatgtcggcgttacccgtgttgatggtcacggcggaagccaagaaagagaatattatcgccgccgcacaggctggcgccagcggttatgtcgtaaaaccgttcaccgcagcgactctggaagagaagctcaacaaaatctttgagaaactgggcatgtgaggatgcgatgatgatgcaaccatctatcaagcctgctgatgaaggctcagcaggagacatcattgcgcgcatcggtagtctgacccgaatgctgcgcgacagcctgcgtgaactggggctggaccaggcgattgccgaagcggcggaggcgatccctgatgcgcgcgaccgtctggattatgtcgtccagatgacggcgcaggcggcggaacgcgcgctaaacagtgtcgaagcctcgcagccgcatcaggatgcgatggaaaaagaggcgaaagcgctaacccaacgttgggacgagtggtttgacaatccgatcgagctttccgacgcccgtgaactggtgacggatacgcgccagtttctcagggatgtcccgggccataccagctttactaacgcgcaactgctggacatcatgatggcgcaggatttccaggatctgacgggtcaggtgatcaaacgcatgatggacgtgattcaggagattgagcgccagttgttaatggtgctgctggaaaacatcccggaacagagcgcgcgaccaaaacgcgagaacgaaagcttgctcaacggcccgcaggtggatacctcgaaagctggcgtcgtcgccagtcaggagcaggtggacgacctgctggacagtcttggcttttaagcttttttgacctgatggcgctgcgcttatcgggtccgaatccgtcaacccggccggatacgatactttcttatcgtatccggctatctctattaacgccataaaccccgccttttttaccgcttactctgcccattggcgtaaagcggttctggcatcattctcgcttatcaatctatccagggtttgctgcgtggcagaagagagcgacgacgacaaaacagaagcccccacaccccaccgacttgaaaaagcgcgggaagaagggcagatcccccgttccagagaactgacctcactgctgatattgctggtgggcgtttgtattatttggttcggcggcgagtcgttagcgcggcagctggcgggaatgctctcagcaggcctgcacttcgatcaccgtatggtgaacgatcctaacctgatcctggggcagataattttgctgattaaagcggcgatgatggcactgctaccgctcatcgcgggcgtggtgctggtggcgcttatctcgccggttatgcttggcggcctgatttttagcggtaagtcgctacagccaaaattttctaaattaaacccgctgccgggaattaagcgcatgttttcggcgcagaccggcgcggaactgctaaaagcggtgttgaaatccacgctggtcggctgcgttaccggcttttatctctggaatcactggccgcaaatgatgcgcctgatggcggagtcgccgatcgtcgcaatggggaatgcgctggatctggttggactctgcgcgttactggtggtactgggcgtgatcccgatggtgggatttgacgtttttttccagatctttagccacctgaaaaaattacgcatgtcgcggcaggacattcgcgacgaatttaaagagagcgaaggcgatccgcatgttaagggcaaaattcgccagatgcaacgcgccgccgcgcagcgccgcatgatggaagatgtgccgaaagcggacgtcattgtcactaacccgacgcactattccgtggcgctgcagtatgacgaaaacaaaatgagcgcgccgaaagtggtcgcgaagggggctggattaatagcgctgcgcattcgcgagatcggcgctgaacatcgggttcccactttagaagcgccgccgctggcgcgggcattatatcgccacgccgaaatcggtcagcaaattcccgggcagttatatgctgccgttgcggaagtgttggcctgggtctggcagcttaaacgctggcggcttgcgggcgggcaacgtcctccacaacctgagaaccttccggtgccagaagcgctggattttatgaacgagaagaatactgatggctaatctggtcgcgatgctgcgcctgcccagcaacctgaaatcgacgcaatggcaaattcttgccgggccgatcctcattctgctgattttgtcgatgatggtgctgccgctacctgcttttatcctcgacttattgtttacctttaatattgcgctatcgatcatggtgctgctggtggcgatgtttacccagcgtactctggattttgccgcgtttccgaccatcctgctgtttaccacgctactgcgtctggcgcttaacgttgcctcaacgcgcattattttgatggaagggcataccggcgcggcggcggcgggaaaggtggtagaggcgttcggtcatttcctggtcggcggtaacttcgcgatcgggattgtggtttttatcatcctcgtcattatcaacttcatggtcatcaccaaaggtgccggacgtattgccgaagtcggcgcgcgctttgtgctggatggtatgcccggtaagcaaatggcgattgacgccgatcttaatgccggtctgattggtgaagacgaggccaaaaaacggcgttcggaagtcactcaggaagccgacttctacggttcgatggacggggcaagtaaatttgtacgcggcgacgccatcgccggtattctcatcatggtcattaacgtggtaggcgggctgctggtcggcgtattacagcacggaatgagcatgggcagcgcggcggaaagctacaccctgctgaccattggcgacggcctggtcgcccagatcccggcgctggttatctccacggcggcgggcgtcattgtgacccgcgtcagtaccgatcaggatgtaggcgagcagatggttggccaactgttcagtaatccaagggtaatgctgctggcggcggcggtgctggggctgcttggcatggtgcctggaatgcctaacctggtatttttactctttaccgccgctttgctcggcctggcatggtggctgcgcgggcgtgaagaaaaagcgccggaggagccgcagccggtaaaaatgccggaaaataactcggtggtcgaagccacctggaatgacgtacagcttgaggattcactgggaatggaagtgggctaccgcctgatcccgatggtggattttcaacaggatggcgaattgctcggacgtattcgcagtattcgtaaaaaattcgcgcaggatatggggttcctgccgccggtggtccacattcgcgacaatatggatttacagcctgcgcgctaccgtattttgatgaaaggggtagagatcggcagcggggacgcctatccgggacgctggctggctattaaccccggcacggcggcgggaacgctaccgggcgagaaaaccgtcgatccagcttttggccttgatgccatctggattgaaagcgccctgaaagagcaggcgcaaattcagggctttaccgtcgtggaagccagtaccgttgtggcgacgcaccttaaccacttgattggccaattctccgccgaactgtttggccgccaggaagcgcagcaactgttggatcgtgtctctcaggagatgcctaaactcacggaagatctggtccccggcgtcgtgaccctcacgactttacacaaagtcctgcaaaacttactggcggaaaaagtccctattcgcgatatgcgcaccattctggaaacgctggcggaacatgcgccgttacaaagcgatccgcatgaattaaccgccgtggtacgcgtggcattagggcgagcgattacgcaacagtggttccccggtaatgaagaagtgcaggtgattggcctggataccgcgctggagcgtttgctgcttcaggcattgcagggcggcggtggacttgagcctgggttggcggatcgcctgctggcgcagacccaagaggcactttctcgccaggaaatgcttggcgcgccgccggtattactggttaaccatgcgctacgtccattattgtcccgctttttgcggcgcagtttaccgcagctggtggtgttgtcgaaccttgagctttccgataaccgtcatatccgcatgacggcgaccattggaggaaaataatgcgtaaatggctggcattgttgctctttcccctaacggttcaggccgcaggcgaaggcgcgtggcaggatagcggtatgggcgtaaccttaaattaccggggcgtttccgcatcgtcttcgccattgtcggcgcgccagccggtttccggtgtgatgacgctggtcgcctggcgttatgaactgaatggcccgacccccgcaggattacgggtacgtttatgttcccagtcccgttgcgtagaacttgatggtcagagtggcacgacccacggttttgctcatgttcccgcagtcgagccgctccgctttgtctgggaagtccccggcggcggcagacttatcccggcgttaaaagtgcggagcaatcaggtgattgtgaactaccgctaaccgcccctttctttgccaggtagcagacctgactctctttttgaataaatagaaacgtcgttttataaaatggtgaggtaggttgccggactctttgcgtttttgccatttacgctctgacaatggcagaaacaaaaaggtttccgcccagcttagcttttactgtagcgaatcgactgcgtcggcggtaaaactgcacgcagcactgaattcgacattacacagaggttaagcaaatgatggtttatccagtcaaacacagtccgctattgcgtcagcctgagcattttatcgccagagatgaactaaaagccctggtgcaaaaggtgacgcataacctggtcaatattaaagatgagacaggcgaatttttattgcgactggacgacggacgcgtgatcgatactaaaggctgggccggatgggagtggacgcacggcgtgggcctgtacggaatgtatcactattaccaacagaccggcgaccagacgatgcgtaagatcattgatgactggtttgccgatcgctttgcggaaggcgcgacgacgaaaaacgttaatacgatggcgccgtttttaacgctggcgtatcgctatgaagagacgcgtaatccagcgtatttaccgtggctggaaacgtgggccgaatgggcgatgaatgaaatgccccgtaccgattacggcggaatgcagcacatcacgctggcggaggaaaatcatcagcagatgtgggacgacacgctaatgatgacggtgctgccgctggcgaaaatcggtaagctgttgaaccggccggaatatgtggaagaggcaacctatcagttcctgctacacgtgcagaatttgatggataaagagacggggctgtggttccacggctggagctatgacggtcatcataacttcgctaacgctcgctgggcgcgcggcaacagctggctgaccattgtggtcccggattttcttgaactgctggacttgccggaaaataatgccgtgcgccgttatctggtccaggtactgaatgcgcagatcgccgcgctggcgaaatgtcaggatgaaagcggtttgtggcatacgctgcttgacgatccgcactcttatcttgaggcgtcggcgacggcgggttttgcctacggtattcttaaagcggtgcgcaaacgctatgtcgaacggcactatgcgcaggtggcggaaaaagctattcgggggatagtgaaacatatctcgccggaaggcgaactgctgcaaacatcatttggcactggcatgggccacgatctcgatttttaccgtcatattccgttgacctctatgccttacgggcaggcgatggcaatgctgtgtttgacggaatatctgcgtaactatttctgatgtatgcagatattccggtcgtatccttgtctgatggcgctttgcttatttgactatggcgcctgacccgactgtgtggtatcagcctgtggatcaaacaggtggtcaaggatttttcgcatgatgggcgcggcggtaacgccgtcgcttccgccgttttccagaatcaaggcaatagcgaccttagggtttttatacggtgcaaaagcggtataaaacacatgatcgcgcaggcgaatggggatcattttcgcattgtaggtctgattttctttcaggctaaacacctgcgacgtgccgcttttggccgcaatgccgtagggcgcggtgtgaaagaacttatagcccgttccgttgggtgcattcgccatgccgtacatcgcctgacgcaccagtccccagtatggcgacgccggatcggctatctgtgccggtgttcctgaaggacgatacggaaccaccgttttgccgctctcttcattgagtaacaggtgaggggcaatcaccttactgttgttgatgagcgccaccatcgcttttaccatctggatgggggtggcaatccagtagccctggccgatgccgacagagatggtatcgccctgataccaggcttttttatggacccgctgtttccatgcgcggctgggaagcagcccgtcatactcttcactaaggtcgatacccgtcggtttgccatagccgaactgagacaacatcgtgtcgatacggtcaatacccatcatataagcgacctaatagaaaaaggtatccgcagattcctcaatcgctttagtgacatccagcataccgtgtccggtttttttccagtcccggtaatgacgctgcgtgccgggaagcgtccaggttggcgcgccaaagaaggtggtttgcggcgtaataatcccgcataacagcgcggacatcgccatatagggtttaaccgttgacgccgggggataaagcccttgcgtcacgcggttgatcagcggcagatttttatcgtgcagcagtttgccgtaatcctgatagctaatgccttttacaaaggggttcgggtcgtagctgggcatagataccatcgctagcactgaaccatcgtgcggatcttcaaccagtacggcagcacgctgcccggccagcaaactttcaatgtactcttgtaaatggagatccaacgtcaggtgaatgttcttacccgcgatgggaggaacgtctttcagcaggcggacaatacgcccgtgattatccacctcgacctcctgataaccggttttgccatgaagatcgttttcgtagtaacgctcaatcccctgtttaccgatgttatggtccgccgcgtaattctctgccagcccttttttatccagcgctttaaggtcgttatcgtttatctttgacacgtaaccgagaacatgcgccagctccgcgccgtaaggatactgccgatcctgatagctattgatcgtgacgccgttgaaatgaaactgattgaccgcaaagcgtgcgatttcaacatccgttagcgcgtttttgagcactaccggacgatagcggctactggattttagcgcgcggcgaaagtcggcgatatcgtcgggggagagatcaacaataggggtgagctgttttagcagcgcatccatatcggcaattttatagggcgtaaccgcgatatcataccaggttacgttacgcaccagcggaatgccgttgcgatcgtaaatgatgccgcgcgtgggcgcgacgggtagcatcttgatatcgttctcattcgaacgggtggtgtagtagtggtgctggcggatttgcaagttatagaggttgaagatcaggataccaaagcagacaaccactacaccaaacgccacaatcacacgtctcaggaagagtttctcttccgcatcaaagtctttaaaagtcattacctgtacctgaacaatccgccgcctaatgatacggggcggtcagcgccagcacaggtaaaagatgttccatctctctatagaaatgtgtcattccttgtgatttgttacagatataccgctgtggcaataaaaaggcctgagtccgttacccggagtcaggcctgatgatgttaacgacggcgcgtttacatgcgttctacggtttcgatacccaacgtatccagacccagtttcagcgtcttcgccgtcagttgcgccagttttaggcggctattgcgaaccgcgtcattctcggcgctgagaatagggcagtgctcgtagaagccggagaacagcccggcgacgtcatacagatacgcgcacatgacgtgcggcgtaccttcacgcgcgaccaccgtcagggtttcttcaaactgcagcagacgggcagcgagctgcgcttcgcgatcttcgctaatgataaccggcgcgctcgccagcgcctgctcgtcgatgtccgctttacggaaaacagacagcacacgcgtataggcatactgcatataaggtgcggtattgccttcgaaagccaacatattatcccagtcgaagatatagtcagtggtgcggttttttgacagatcggcgtatttcaccgcgccaataccgacggcgttagccagtttttccagctcgtcagccggcatatccgggttcttctccgccaccagacgacgcgcgcgctccagcgcctcatccagcaggtccgccagtttcaccgtaccgcccgtgcgagttttaaacggtttaccgtctttacccaacatcatgccgaacatgtggtgttccagcggaacggaatccggcacataaccggctttacgcacaatggtccaggcctgcatcaggtgctggtgctgacgggagtcaatgtagtagagcacgcggtcggcgtgcagcgtttcgtaacggtatttggcgcaggcgatatcggtagtggtatacagataaccgccatctttcttctgaataatgacgcccatcgggtcgccttccttgtttttaaactcatcaaggaaaaccaccgttgcgccttcgctttcaaccgccaggcctttggctttcagatcggcgacgatgcccggcagcatcggattatacagactttcgcccatcacatcgtcacgcgtcagagtgacgttcagacgatcataggtgatctggttttgcgtcatcgtgatatcaaccagcttacgccacatctcacggaaataggtatcaccgctctgcaatttgacgacgtagttacgcgcgcgctcggcaaacgtttcatcttcgtcataatgttttttcgcatcgcggtaaaatccttcgagatccgccagcgccatgtcgcccgcgttttcctgctgctgtttttccagccaagcgataagcataccgaactgggtgccccagtcgccgacgtggttagcgcgaataacatgatggcccagaaactccagcgtgcgcactgccgcatcgccaatgatcgtggagcgtagatgaccaacgtgcatctctttcgcgacgttgggcgcggagtagtcgacgacaatcgtctggcgagtcggctgagaaacgcccagacgatcggaggtcagcgcctgttgcacctgttcagcgagaaaagccggttcgaggaaaatattgataaagccagggccggcgatttcaaccttgctggcgatgccgctgagatccagatgagtcagcacctgctctgcaagttgtcggggggccatacccagttttttcgcaactgccatcatgccgttggcctgatagtcgccgaactgaactttggctgactgacgaacctggggctcgcaatctgcaggcgcgcctgcagcaatcatggcctgactaactttttctgagagaagagcctgaatattcaccggaataccttacgtttatgaagcggactgtattgcccgcgccagtttaagaattagggcgggagtatactgcaaatgcccgttggcgtcagcattgcgcgcgcggcgcgtcgcctgaaatatacgcaacaataatctgcataagcattcaataaacgcccaatcaaatcaaaggttggttgccggggcgcaacagcgtaaattagcggttttcacagcaagaagagcgtcctgatatggcgaactggcaacacattgatgaactgcatgatatttccgcagatttaccgcgattcactctggcgttcagagaactttccactcgccttggtctgcagattaacgcccttgaggccgatcacatttcattgcgctgtcaccagaatacgacggcggagcgttggcgtcgcggttttgaacaatgcggcgagctactgtcggaaaatatcatcaacggcaggccgatttgtctgtttaaactgcatgaaccggtatgtgtggaacactggcggttttctgttattgaattaccgtggccgggagaaaaacgctatccacacgaagggtgggagcatattgaaatcgtgctgcccggcgagccggagaccttgaacgcgagggccctggcgttgttgtcggatgaggggcttagtcagccggggatcgtggttaaaaccagttcgccacagggcgagcatgaacgtttgccaaaccctacgctggctgtgaccgatggccgcgtcacggtaaaatttcatccatggtcgattgaagcgattgtcgccagcgaacaggcggcccattaacctgccgagcggagtgaatatggcgttacttgagatctgttgttacagcatggaatgcgcgctcaccgcgcagcgaaacggcgcggatcgtatcgaactgtgcgccgcgccgaaagaaggggggcttacgccttctttcggcatcttacgcagcgtacgcgagcatattacgattcccgtacatccgattattcgtcctcgcggcggagatttttactacactgacggcgaatttgccgccatgctggaagatatccgtctcgtcagagagttggggtttcccgggctggttactggcgtgttgaccgttgatggggatgtcgatatgtcgcgaatggaaaaaataatggcggcggccgggccgctggcggtgacattccaccgcgccttcgatatgtgcgctaatcccttcaatgcgctaaagaatctggctgacgcaggcgtagcaagagtactgacttccgggcaaaaagccgatgcggcgcaaggtttatcaataattatggaacttattgcccagggggatgctccaatcattatggctggtgcgggggttcgtgcaaataacctgcagaatttcctcgatgccggagtacgggaagtacacagttccgccggagtcttactgccttcgccgatgcgctatcgcaatcaggggttatcgatgtctgccgatatacaggcggacgagtattctcgctatagggtagagggtgcggcggtcgctgagaatgaaaggaatcattgttcgccatcaggccaaatgatttttaccgttgcatcatgtcgcccaatatgatgcttgctcgtaccaggcccctgccaattcaacaggggcctttttttctccttcatatttcaagccgcagcagcgttggccgcctcgcgcaccccggtcacgtagctacctacgttcccggggatttgctgcgttgccgccttgctgcaacttgaactattttggagaaacggtgctatacgtaacggtcattcggcaatccatcacggtttacgcgcaatcagcaccgcgcgctgcggggcgggatagccttccaccgtcttgctgcgatcgttcgggtcaagaaaatcggccagcgactcggtaaccatccattcggtacggcgctgctcttcggtggtagtgacgcaaacgtcagcgatacgcacatcaacaaagccgcatttttccagccatttttttaatgccggcgcggaaggaataaaatagacgttacgcatctgcgcgtagcggtcacccggcaccagtacggtattttcgtcgccgtcgacgaccagcgtttccagtaccagctcaccctcgttgaccaactgatcttttaattgccacagatgctccagcggcgagcgacggtgataaagcacccccattgaaaagacggtatcaaatgctttcagcgccgggagttgttcaatgcccaacggcagcagatgcgcgcgctgatcgttacccaacagtttacgcaccgcctcaaattggcagaggaaaagctgtgtaggatcgatgccgaccgccagatgtgcgcccgcgccaatcatccgccacaggtgatagccgctgccgcagccgacatcaaggatcgtccggccggttaaatctgacagatgcggcagtacgcgatcccacttccagtctgagcgccattcggtatcaatatctacgccataaagcgagaacgggcctttacgccacggcatcagattacgcagcaatgtatcaatacgctttagctgaccttcgctgagcggcgtttcgctttccgccgtgacgctgtgcagtaaatccagccgccagggcgtaatttccggtaaaaattctaccgcgttcgaccactgtttaaacaagccatgctgctgctcgcgttgccaggcggcaatctgcgcgggcaatgtttccagccagtgggagagatgatttttagcaatgagctgataaaagttaccaaactcgatcatgcggcaactccggcttttaacgcgacaagcgacccgaagttaaagcactggaaccacagttcgctgtgttcgaaacccgcctgacgcaggcgcgctttatgtgtttccaccgagtcggtgagcatcacgttttccagcatactgcgcttttggctgatctccagttcgctgtacccattagcgcgtttaaaatcgtggtgcatgttgaataacagctcgcccactttcgcgtcttcaaagctaaatttttccgacagtaccagcgcgccgccgggattcaaccccaggtaaatcttatccagcaatgcctggcgttcggcaggttcaaggaattgtagggtaaaattcagcaccaccatcgaggcgttttcaatagtgatatcgcggatatcgccttcaacgacttcaaccggcgtaggcgctttatacgcatcaatatgacggcggcagcgttcaatcatggccggggagttatcgacggcgataatgcgacaatgctcatggcggatattacgccgaacagacagcgtcgcggcacccagcgagcagcccagatcgtagacctgcgtgttcggctgcacaaagcgttcagctaacatgccgatcatggagatgatgttggagtagcctggtaccgaacgctgaatcatgtcggggaaaacttcggctactcgttcatcaaaagtccagtcgccgagacgggcgataggcgcagaaaaaagcgtgtcgcggtgagacataacgtatacatccgggaaaaataaaggcgcatattgtgcgctaatacagggagaaaaccaactcccagggcatataccacaggtttgccagcaccatcagcaacaatgcgcaccaggtcgcgctcatccccgcccgccgccagcggaacaggcggtggtgaaaaccgtaataatgcatcagccgaccggcgattaaaatgatgccgcagatatgcaccatccacgtttcggcgccgttcatttccataaacagcagcagcaccagcgcgacaggaatatattccaccgcgttgccatgaatacggatggcgctttgcaattcgctaaaaccgccgtcgccataggcgacacggtactgcattcgtaagcgaacgacattaaaagagaacttcattaataataacgcacccaaaacggcatacagcgcgcttaccatacaaactcccttttaaaatggctgatggcactgtctatgatagggggcattttcagaaaagagaagattgctgtggaatggacggagcagtgccgatttccggtaagacgctgcgtaaatcatgccaaagcgtattcaccagttccggcgcctgcgcgatatccggagtatgtaaaaacagaaaaggcgtggtggtctgccgccactgcgggagtttctgcaaccaggcagcgaaaaactcacggttttgcgccatattatcgctaccgataaaacgcaccatcggatggctggccgtcacgaccgcatgtaccgggactttgggtttttttcgctgcgcgtcacggacggcctcgctgtggggatgggcggcatgtaccggacgactatccaggatcacgcggtttacgccgcgcgcgtgtaacccgcgattgagccgctgttcatcctcacccttgtcaaaaaaacacggatgacgaacttctacgccataggtaaacgtggcggggagcgcatcaagaaactgccataaggcggggagatcgcgcggtccaaaggcggcgggcaactgcagccagtattggccaatacgcgtttccagcggcgccaggcgggtaaaaaacgcctgtaccagatcgtcgcaatggcgcagagcggcctggtgagaaatggtggcgggaaatttaaagcaaaaacggaaatcgtccgtagtttgcgcataccagcgatcgacaatttccgctttcggcagcgcgtaaagcgtggtgttgccctccacgcagttaaagtggcgggcatactcttccagactggtgatgccgagccgcgcccatttcgggtgcgaccattgcggcaagccaatgtagatcataaggcgtttaaaatatcctctacgctgcgtacccggccaatgcgcgggaaaatatgcgtcatactgctctgatgctgctcactgctggcggcgctacaggcatcttcggcaataataaggttaaatcccaactcccaggcgttacgcgctgtggattcgacgccgatattggttgagattccgcacaatatgatggtgtcgataccccggcggcgaagctgtaattccaggtcggtgccgtaaaacgcgccccactggcgtttagtcacttccagatcgctgtcctttttacccaatgccgtaggccaggtccaccagttttccggcaacgcgtgcgcaggcgttgcggcatccaccggctgttttaacgcttcggcataatcatcagaccatccaacgcgtaccataaccacgggcgagccgttggcgcgacacttttccgccagccgcgcggcgcgggcgaccacctcatttgccgtatacgggccgccggcaaacggaagaattccttcctgtaaatcaataaccaccagggcggttgtggtcgcgttgagtttcagcatgataatcactctcctaaaaatagcggatttcactacaccttaagcgcgattaaagaggaaagcggcgacaaatattgttaatttttgtgagcatacgcaatacccgcgtgaaaaacccgggtacagtcagtatgaaccaagtgtcgataccgcatgaaacgggcaagttatcgctcccatgctggattgactcttatcgtgcggcagaatttccagtataatagccgccttttttcatccagttgtgacatacagctaaagctgcgacttcgtcgcctgcatggcaggcaacaatccgcctgcggctaagttaagggatatctcatgcgtacagaatattgcggacagctacgtctgtcccacgtggggcagcaggtgactctgtgtggttgggtcaaccgtcgtcgtgatcttggcagcctgatctttatcgatatgcgcgaccgcgaaggtattgtgcaggtgttcttcgatccggatcgtgcggacgcgttaaagctggcctctgaactgcgtaatgagttctgcattcaggttacgggcaccgtgcgtgcgcgtgacgcgaaaaacgtcaatgcggatatggcgaccggcgaaattgaagtgctggcgtcctctctcactatcatcaaccgcgcagactcactgccgcttgacgctaaccacgttaataccgaagaggcgcgtctcaagtaccgctatctggatttgcgtcgtccggaaatggcgcagcgcctgaaaactcgcgccaaaattaccagcctggtgcgtcgttttatggacgatcacggtttccttgatattgaaaccccgatgctgaccaaagcgaccccggaaggcgcgcgcgattacctggtaccgtcccgcgtacacaaaggtaaattctatgcgttgccgcagtcgccgcagctgttcaaacagctcctgatgatgtccggtttcgaccgttactatcagatagtcaaatgcttccgtgatgaagacttacgtgctgaccgtcagccggagtttactcagatcgacgtcgagacctccttcatgaccgcgccacaggtgcgcgaagtgatggaagcgctggtgcgccatttgtggctggaagtgaaaggcgtggatctgggggatttcccggtcatgacgtttgccgaagcggaacgtcgctacggttccgacaagccagacctgcgtaacccgatggagctggtagatgtcgctgacctgctgaaatcggtagagttcgcggtcttcgcgggcccggctaacgatccgaaaggccgcgtggcagcgctgcgtgtgcctggcggcgcacagcttagccgtaagcagatcgacgattacggtaactttgttaagatctacggcgcgaaaggactggcatatatcaaagttaacgagcgcgcgaaaggtctggacgggattaacagtccggtggccaagttcctgaccgccgacatcgtcgaggctatccttgaacgtaccggcgcgcaggacggcgacatgatcttcttcggcgcagataacaaaaaagtggttgccgatgcgctgggcgcgctgcgtctgaaactgggcaaagacctgagcctgaccgacgaagacaaatgggcgccgctgtgggtgattgacttcccgatgttcgaagacgacggcgaaggcggtctgaccgcgatgcaccatccgttcaccgccccgcgtgacatgacggcgtctgaactgaaaactgccccggaagaagccgtcgctaacgcttacgatatggtgattaacggctatgaagtgggtggcggttcggtgcgtattcacaacggtgaaatgcagcaaaccgtatttggtattctcggtatcaatgagcaggagcagcgcgagaagttcggcttcctgttggatgcgttgaaatacggtacgccgccgcacgtgggcctggcgtttggtctggaccgtctgaccatgctgttgaccggcaccgacaatattcgtgatgttatcgccttcccgaaaacgaccgccgccgcgtgtctgatgactgaagcgccgagtttcgccaaccaggcagcgttgacggagttggggattcaggttgtgaagaaagccgagaataactgatatgaacaatgtacacgacatcattcgcgtgatatcgcggcggcccgcaagggggagtctcatcaatgcgcggcgtcacccaacagccaacaacgaggtcgcgtgaaggataaagtgtacaagcgccccgtttcggtcctggtggttattttcgcgcaggatacgaaacgggtgctaatgttgcagcgacgcgacgacccggatttttggcagtcagtgactggcagcatagaagaaggggagaccgcgttgcagaccgccgtgcgtgaagtcaaagaggaggtcacgattgatgttgcggcagagcaactgaccttagtcgactgccaacgtacggtggagtttgaaattttttcacatttacgtcatcgctatgcgccgggcgtcatgcacaatacagaattctggttctgccttgcgttaccgcatgagcggcaggtgatattcactgaacatctaacgtaccagtggcttgatgcgcctgacgcggcggcgcttaccaagtcctggagtaaccggcaagcgattgaagagtttgtcattaacgtcgcctgaaaaggcgcgctttttttgaggaaatatttatggcaggtcatagtaaatgggccaacaccagacatcgtaaagctgcgcaagatgccaagcgcggtaaaatcttcactaaaattattcgtgaactggtaacggcagctaaattgggcggcggcgatccggatgccaacccgcgtctgcgcgcggctgtagataaagcgctggccaacaacatgacccgcgacactctgaaccgtgccatcgctcgcggtgtgggtggtgatgaagactcgaacatggaaaccatcatctatgaaggttatggtcctggcggcacggccattatgattgagtgtttgagtgacaaccgtaaccgtaccgtagcggaagtgcgtcatgctttcagcaagtgcggcggtaatctgggtaccgatggctcagtggcgtacctgttcagtaagaaaggggtcatctcctttgagaaaggcgatgaagacaccatcatggaagccgcactggaagctggcgcggaagatgttgtgacctatgatgatggcgcgattgatgtttacactgcctgggaagagatgggcaaagtgcgtgacgcgctggaagcggcgggtctgaaagcggacagcgccgaagtgtccatgatcccgtcaaccaaagcggatatggatgcggaaaccgcgccgaaactgctacgtcttatcgatatgctggaagactgtgacgatgttcaggaagtctaccataacggtgagatctctgatgaggtggcggcgaccctgtaatggtgctgctaaacgccggcgggcagggggtatagcgtgtcgattattctcggtattgaccccggctcgcgtattaccggttatggcgttatccgccaggtaggcagacaactgacctatctgggcagcggatgtattcgtaccaaagtcgatgatttgccgtctcgtttgaagctcatatacgcaggcgtgacggaaatcatcacgcagttccagccggactattttgctatcgaacaagtgtttatggcgaagaatgccgattcagccctcaagctgggacaggcgcgcggcgtagcgattgtcgccgcggtcaaccaggaactgcccgtgtttgaatacgcggcgcgtcaggtgaagcaaactgtcgtcggtattggtagcgcggagaaaagccaggtacagcatatggttcgtacgttgctgaagctccccgctaacccgcaggcagacgccgcagatgcgctggctatcgccattacgcattgccatgttagccagaacgcgatgcaaatgagcgagagccgactcaatctggcgcggggaaggttgcgctaaattattctccctcagcctcgcgttgagggttttcaattccacaggcgctaattaattctaaattgggatgttgccacaggctggcgggcgtcaccgtcttacgatcccacgggattgaacctaaaaaccagaatttccagaaggtgagtttcgcatcaggattgctgtgaagtaattcttcgaatgtctcaatatcgcctaccggaatacacaatgcttctttatagatatcaaacacaaatttcgagcagaactggcgcgatgactcgtatttaaaccccgtgtgataaaacttattcagccgggcgggaacctgctccatgatggcgagtttctgctcgaccgtcaggccgccgcacaggcgacgaaccgcgtaacgttgtccggctgaacgttgtataaacagtgacagcgtggtgacggttgagagggggacgcgactttccgccaccagatagtcatcaccattatgaccaataataatcccaacatggttgctccagcactgtgaagcggtggatatctggccgaaaagcgcggcacctatacaggtaaagacgatatccccggtttcatattggacaggataatgttttttcatctctgcattccattatttgaaataaattccttttatttattctacagggtagttagcattataccagataaatgacaagccttagtgtcatcgaaatatgtatggtgaatatttcatttgttggaattaatgtcgcaaatataactggggaggaattaaggtggtaaatttctcattatctgctctcttatattgacagggagtacgacgtggttgatgataaaccaatgaaaataggttgggtgttttatttttcttatatttttgttgctattatctttcatctgtttattagtttttgttattgtttgagtattgatatggcagaggctaataccgttgtttttttattaaagccagggacgatttcattattatttttacttctccctgccaggcggttcagaaccagactgttggcaacattgagttcagttttcattgccttagtatttaaccagtggcatttggttgccgggaataaagaactggttttgtgcatgcaggcagcgtgctttatggctttcctggctatgacatcggtaaaaaaatccgggtggatgattagcgcatcattatttttggtttgtgcggccggaacgattcgccagtgctggctggaacagttgtttaacgctgccgatatatatattgttgatgatgggcggagctgtggtgccagcggccactgcttccagtatattgcagcaaaaggccgtgggttagcagcaaaacgacaggcactttttagtagtgaagagtatgtgaatatttattatagttattcagaagggataccagccgtgaatttcgatggcatgaaaaatgagtttgcacaatatttattgtgtcatggtgaattaaaatatgttgtgcgcgacgataaaacaacatgcgattaaattcagcgctagtggttaattttattaaatctattctcgggtctgttttttggggggaccgatgttccgctgttggcattcgtactggatacagtattagtgttatcaggatactcattattgaagactaccaaacttgcgccacggcatgttggcaaaaagttattcgcgtaggacgcaaaaagttgtcaatgagtgtacgacttattttgtacgcagcggggagcgtgcccgtcgttaactatcgcgggttgtcggagtacagaaatatcgggataagtgtttttcatctggataaacatccagtctttttttatgatagtgcattatcttttcagccctttacgcaggagcgtcatgtgataggcagactcagaggcattattctcgaaaaacaacccccgatcgtgctgctggagacagggggcgtaggctatgaagtacatatgcctatgacctgcttttacgagctgccggaggccgggcaggaggcaatcgtcttcacccacttcgtggtgcgtgaagatgcgcagttgctgtacggatttaacaataagcaagagcgcacgctatttaaagagctaattaaaacgaatggcgtcgggcctaagctggcgctggcgatcctctccggcatgtcggcgcagcagtttgtgaatgcggttgagcgcgaagagctgggtgcgctggtgaagctgccgggtatcggcaagaaaaccgccgaaaggctgattgtcgaaatgaaagaccgctttaaagggctacatggcgatctctttacgccagcggtcgatctggtattgacgtcgccggccagcccaacctcggaagatgcagaacaagaagcagttgctgcgctggtggcgctgggttataaaccgcaagaagccagtcggatggtaagtaagatcgcccgtccggacgcaagcagtgaaacactgattcgcgacgcgttacgcgccgcgctatgaggtaaaggatgatagaagcagatcgcctgatttcagcaggcgccacgatcgcagaagacgtcgccgatcgcgccattcgcccgaagttattggcggaatatgtcggccaaccgcaggtgcgctcccagatggagatctttattcaggcggcaaaacggcgtggcgacgcattagatcacttgctgattttcggcccgccagggttaggtaaaacgactctggcgaatatcgttgccaatgaaatgggcgtcaacctccgaaccacgtccggcccggtgctggaaaaagcaggcgatctggcggctatgctcaccaatcttgaaccgcatgatgtgctgtttattgatgagatccaccggctttcaccggtggtggaagaggtactctatccggcgatggaagattaccagttggatattatgattggcgaagggccggctgcacgttcaattaaaatcgatctgccgccgtttacgctcattggcgcgacgacgcgcgccgggtcgttaacgtccccgctacgtgaccgttttggtattgtgcagcgcctggagttctaccaggtgcccgatctgcagcacatcgtcgggcgcagcgcaaggcacatggggcttgagatgagcgatgacggcgcgctggaagtggcgcgtcgggcgcgcggtacgccgcgtatagccaaccgcctgctcagacgtgtgcgtgattttgctgaggtgaagcatgacggggctatttcagcggaaattgccgcgcaggcgctggatatgctgaacgtcgatgcggaagggtttgattatatggatcgcaagctactgctggcggttattgataaattcttcggtggcccggtgggactggataatctggcggcggcgattggcgaagagcgtgaaaccattgaggatgtgctggagccgtatctgattcagcaaggctttttgcagcgcacgccgcgtgggcgtatggcaacggtgcgcgcctggaaccactttggtattacgccgccagagatgccttaacgcctgaagtcgctgcgctcatcaggcctgggcgattttgtaggcccggtaagcgcagcgccaccgggcaacacacgcttagcttgcctgctttttcatcatactgaagataaacagcagcgcggcacacagcactacggatggccctgccggggtatcataaaaggctgagaaggtcagtccacctgtaaccgctatcatacctacaccaacggcgacgcccgccatctgctccggcgtacgggcaaagcgacgcgcggttgcggcggggataatcagcagcgaggtgataatcagcgctccgacaaacttcatcgttacgccaatggttaacgccgttaccagcatcaatagcagcttcacgcgctgtaacttcacgccatcgacaaaggcaagatccggactgatagtcattgacagcaagttgcgccactgccagaagagaatggccagcacaataacgaccccaatagcgatcgagataagatcttccggcgtcacggccagcaaatcgccaaacagataagccattaaatcaacgcggacgttggacatcaggctgaccacgaccagtcctaaagacaaggcgctgtgtgccataatgcccagtaaggtatcaatcgcgaggtgagggcgtttctccagccataccagaccggaggccagcagcagcgtaacggcgattaccgcataaaaggggttaacgtccagcaacaggccaaacgccacgcccagaagcgacgcgtgagccagcgtatcgccaaaataggacatccgacgccagaccacaaatgagcccaacggaccagcagcgcaggccagcatcatcccggccagccagccgggcagtaataattcaatcatgagtgaccatttccccggcgcagtacaatacgaccctgtaaatcgtggcgatgattatgatgatggcgataaatccctaattgctccgcgccacgcgggccaaacatagagataaattccggatgcatagacaccacttccggcgcgccggaacagcaaatatgatggttcaggcataacacttcatccgtttttgccatgaccagatgtagatcatgcgacaccatcagaacggcgcaatcgagttcacggcgcagctgatcgataaggtcgtataacgcgacctggccgttgacatccacgccttgcgtcggctcatcaagtaccagcaactgcggcctgttaagcagagcacgggccagcagtacgcgctgtgtctcaccgccggagagtttttgcatgggcgcgtcaatcaaatgtccggcctgaacgcgtttaagcgccgggagaatatccgttttttgcgtgcagggacgtaaacgtaaaaatcggtttaccgtcagcggaagcgtggtatcgagatagagcttttgcgggacatagccgatacggagttgcccgttgcgcttgatcaccccttcatcaggggctaccagtcctaaaaccacgcgtacaagcgttgacttccccgcaccgttagggccgagaagcgttaaaatttttccggggctcaattcaagcgacacgtcagagaggacgcggcgttgaccaaatgagaccgagacgttttccagtgaaactaaacttgtcatgttaattttaggcttgcagaagtgatagaatgttataatatcacatttcacatattcattacgatgattagtcgcattatgttacagaaaaatacgcttcttttcgcagcattatccgccgcgctttgggggagtgcaacccaggctgccgacgccgccgttgtcgcttcgcttaaaccgcttgggtttattgcttccgccattgctgatggcgttacggatacgcaagtattacttccggatggggcatccgagcatgattattcattgcgtccatcagacgtaaaacgcttacagggcgcggacttagtcgtctgggttggcccggaaatggaagcctttatggagaagtcggtcaggaatatccctgataataagcaggttaccattgcgcaacttgccgatgtaaaaccgttactcatgaagggcgcggatgatgatgaggatgaacatgcgcatacgggcgccgatgaggaaaaaggtgacgtacatcaccatcacggcgaatataacatgcatctttggctctccccagagatagcgcgggctacagcggttgcaatccatgaaaaattagtggaacttatgccgcaaagtcgagctaaactcgacgccaacctgaaggattttgaggcacaattagccgcaaccgataaacaggtcggtaacgagctcgcgccgctcaaggggaaagggtatttcgtttttcatgacgcctacggttactacgaaaaacactacggactcaccccactcggtcactttaccgtgaaccctgagatacaacctggcgcgcagcgtttacatgaaataagaacacagttggttgagcaaaaagcaacctgcgtttttgctgagccacaattcaggccagcggtcgtggaagccgtggcgagagggacatccgttcgaatgggaacactggaccccctcgggacgaacattaaactgggtaaaacaagctattcagcgtttttaagccaattagccaaccagtatgcgagctgcctgaaaggagattaacgaggaagtgaatacgtgcaacagatagccggctctgtcgccctggcatttaataatctgccccgaccccaccgcgttatgctggggtcacttaccgttctgacactggccgtcgccgtatggcggccctatgtttaccacccagaatccgcaccaatcgttaaaactattgaactggagaaaagcgagattcgttccctcttaccggaggccagcgaacccatcgatcaggccgcgcaggaagatgaagctattcctcaggatgagctggacgataaaaccgcaggcgaagtcggcgtccatgaatacgtcgtctccacaggcgatacgttaagcagtattctgaatcagtacggcatcgatatgagcgatattagccgacttgccgcttctgataaggagctgcgcaatctgaaaattggccaacagctttcctggacactgaccgccgatggcgatttacagcgtctgacatgggaagtctcccgccgtgaaacgcgtacctacgatcgcactgccaacggttttaaaatgagcagtgaaatgcagcagggggactgggtcaacagtctgctgaaaggcacggtagggggcagctttgtcgccagcgcgaaagaggctggtttaaccagcagcgaaatcagcgcagtgataaaagcaatgcagtggcagatggattttcggaagctgaaaaagggcgatgaattttcggttctgatgtcgcgtgagatgctggatggcaagcgtgaacagagtcagttgttgggcgtgcgtatgcgttccgatggtaaagattactacgccattcgcgccgctgacggtaaattctatgaccgtaacggtgttggcctggcgaaaggctttttacgcttcccgaccgccaaacagttccgcatctcctccaacttcaatccgcgtcgtctgaacccggttaccggacgcgttgcgccgcatcgtggcgttgactttgcgatgccgcagggtacgccggtgctgtcggtgggggatggcgaggtcgtggttgctaaacgtagcggcgctgccggttactacattgcgattcgtcatggacgcacctacaccacacgttacatgcacttgcgtaagctgctggtgaaaccggggcaaaaagtgaaacgtggcgatcgtattgcgctttctggtaacaccgggcgttccacagggccgcatctgcattatgaggtatggatcaaccagcaagccgttaaccctctgacagcaaaattgccgcgcacggaaggtctgacggggtcagatcgtcgtgaatacctggcacaggtgaaagagattctgccgcaactgcgcttcgattaacaaatgcgttgacagagccggtacgcgatgtgtgccggctgttttgttttgtgtgcggcgcagacatcgctacactattcacaattccttttcgcgtcagcagaccctggaaaagcatggaaaccaaaaaaaataatagtgagtatatccctgaattcgaaaaatcctttcgctatccgcagtattggggcgcctggttgggcgctgcggcaatggcggggatcgcattaacgccggcatcattccgcgaccctttgctggcgacgctggggcgttttgccggacggctggggaagagttctcgtcgccgggcgctaattaatctgtcattgtgctttccgcagcgtagcgaagctgaacgcgaagcgattgtcgatgagatgttcgccaccgcgccgcaggcaatggcgatgatggctgagctggcgatgcgcggtccgaaaaaaattcaacagcgtgttgactgggaaggtctggagattatcgaggagatgcgtcgtaacgacgaaaaagttatttttctcgtaccgcatggctggggcgtcgacattccagccatgctgatggcctctcaggggcaaaaaatggcggcgatgtttcataatcagggtaatccggtttttgactatatctggaataccgtgcgtcggcgttttggcggacgtttgcatgcgcgcaatgacgggattaaaccctttattcagtctgttcgtcagggctactggggttactacctgccggaccaggatcatggcccggagcatagtgaattcgttgatttctttgcgacatacaaagcaacgctgcctgcaattggtcggctgatgaaagtgtgccgcgcacgcgtgataccgcttttcccggtgtataatggtaaaacgcatcgcctgactatccagattcgtccgccaatggacgatctgctcacggctgacgaccacactatcgccagacggatgaacgaagaggtcgaaatttttgtcggcccgcatccggaacagtacacctggattctgaagttgctcaaaacccgcaagccaggcgagattcagccgtataagcgtaaagatctttatcccatcaaataaataaagcctctcgtaagagaggctttatgctgacaaaccctgtattacctgatgagcaggccagggggagctttactcaacggtcaaaatacgcgtggtattggttgaaccgacggtgctcatgacatcgccctgggtcacgataaccaggtcaccggaaaccagataccctttatcgcgcagcagattaacagcttcatgcgccgcgacaacgccatcagccgcgctatcaaaatgcaccggcgttactccgcggtagagcgcggtcaggttcagcgtgcgttcatggcgcgacatggcgaaaatcggcaggccggagctgatacgggaagtcattagcgcggtacgaccggattccgtcatggtgatgatcgcggtaacgcctttcagatggtttgccgcatacatcgcagacatggcaatggcttcttcaacattgtcgaactgcacgtcgagacggtgtttagacacattgatgctggggattttttctgcgcccagacagacgcgcgccattgcggcaacggtttcagaaggatactgaccggctgcggtttcggcagacagcataactgcatccgtgccatccaggacggcgttcgccacgtccatcacttccgcacgggtcggcatcgggttggtgatcatcgactccatcatctgcgttgcggtgatgactgcgcggtttagctgacgcgcacggcgaatcagcgccttctggataccaaccagctccggatcgccgatttcaacgcccaggttgccacgtgcgaccatcacaacgtcagaggccagaatgatatcgtccatagcgttttgatcgcataccgcttcggcgcgttcgactttagccacaattttcgcgtcacagccggcgtcgcgcgccaggcggcgtgcatagttcagatcttcgccgcagcgcgggaaggagactgccagatagtcaacgcctatcagcgcagcggtttgaatatcggctttatctttttcggtcagcgcttcagcagaaagcccgccgccgagcttgttaatgcctttattgttagacagcgggccgccgacggtgacctcggtaaagactttcatgccctggacttcaagcactttcaactgcactcgaccatcgtcaagcagcaggatatcgccaggaacgacgtctgccggcaaccctttgtaatcaatgccgactttttctttatcgccttcgcctttacccaggttagcgtctaacagaaatttgtccccgatattgaggaacactttgccttctttaaaagtggaaacgcgaatttttggcccttgcaggtcgcctaaaatagccacatgacgccccaatttggcggcaatctcacggactttatcagcacgcattttatgatcttccggcgagccgtgagagaagttcatacgtactacgtttgcgcccgcggcgataaccttctcaaggttgttatcgcggtcagttgccgggcctaacgtggtaacgattttggttctgcgaagccttctggacatgtaatactccgttgactaaaacaacttggtgttgcgtgaacattgatccggtcgttctgaaaccttaacggtataaaatgaacgtccccggatgacgaaaagggtagaacattgttattgcttttagcggtcatcactcctgatgagtaattctttatcaaaacgcgattccttgagcgcttccttgacacgcttcaagttatctctgaattttgccccgcgacgcaaagtaaatcccgttgccagcacatctatcacggtcagttgagcaagtcgagagaccatgggcatataaatgtctgtatcttccggtacgtcgagggtaatggccagcgtggcttcgcgcgccagcggcgttccagcggaggtcagggcgatcaccatcgcatcgttttcccgcgccaactgcgccagttccaccaggctcttggttctgccagtatgcgaaatgagcacgacgacgtcatcatcgttacaattcatacagctcatccgttgcagcacgatatcgtcggagtaaatcaccggcacattgaagcgaaaaaacttattcatggcgtcatgcgcgaccgcggcggaggaaccaagaccaaaaaaggcgattttttttgcctgggtcagtaaatcgacggcgcggttgacggccgatttatccagcgactgacgaacatggtcgagactggccatggcggactcgaagatttttcctgtataggcctcaacgctgtcatcttcatccacattgcgattaacatagggggtgccatttgccagactttgcgccagatgcagtttaaaatcaggaaagccgcgggtattcatgctgcgacagaaacggttcaccgttggctcgctaacgttagcttcctgggccagcatggcaatgcttaagtgaatcgatctgcctggggcggccagaataacatcggcgacttttcgttcagatttgcttaaatgttccagttgagactggactttttccagcatattcatgattagcaaggctcatgggtattagcgatttcaatgatgcgcgaaaccgagcgcgttttgttagatattactcctggcggctgtcaaagggggcaaaatggctaaaaaaggtgtcgttttttttcattacatgaccgacgtcggattttaagttccagcttgtgtggaaaagcgacaattttattaggcgttttgccgattatattgccaatcaaacgccggttcacctatgaaaaggcgtttacggtttccgtaatctcgtaaaagcagtacagtgctgtgtaataaaattacaacgatatcctggctaaagtaccaggagattaactgaggagaatgacatggcggtaacgcaaacagcccaggcatgtgacctggtcattttcggcgcgaaaggcgacctggcgcgccggaaactgctgccttccctgtatcagcttgagaaagccggccagatccatccggatacccggatcattggggtggggcgcgcggactgggataaagaagcttatacccacgttgtgcgtgaggcgctggaaaccttcatgaaggaaaaaattgatgaaggcttgtgggatacgctgagcggccgtctggatttttgtaatcttgacgttaacgatacgcctgcgttcagtcgcctgggcgatatgctggatcaaaaaaaccgcaccaccattaactattttgcgatgccgcccagcacgtttggcgctatttgcaaagggttaggggaggctaaactcaacgccaaaccggcgcgtgtcgtgatggagaaaccgttgggtacttcgctggcgacctcgcgtgagattaacgatcgggtcggcgaatactttgaagagtgccaagtatatcgtatcgaccactatctgggcaaagaaacggttctcaacctgctggcgctgcgttttgccaactcgttattcgttaataactgggataaccgcactatcgatcacgttgagattaccgtagcggaagaggtggggattgaagggcgctggggatattttgaccaggccggtcagatgcgcgatatgatccagaaccacttgctgcaaattctctgcatgattgccatgtcaccgccgtctgacctgagcgccgacagtattcgcgatgaaaaagtaaaagtgttgaaatcgttgcgccgtattgatcgctccaacgtgcgtgaaaaaacggttcgtggtcaatacaccgcgggctttgcgcagggtcaaaaggtgccgggctatctggaagaagagggcgcgaataaaagcagcaacaccgaaactttcgtcgcgatccgcgtcgacatcgataactggcgttgggcgggcgtgccattctatctgcgcaccggcaagcgtctgccaactaagtgctctgaagtcgtggtttatttcaagacgcctgaactgaatctctttaaagagtcctggcaagacctgccgcagaacaaattgacgattcgcctgcagccggatgaaggcgtagatattcaggtacttaacaaagtaccgaggctggatcataagcataatctgcaaatcacgaagcttgatctgagctactccgagacctttaatcagacgcacctggcggatgcatatgagcgcctgctgctggaaacgatgcgtggcattcaggcgctgtttgtccgccgtgacgaagtggaagaagcctggaagtgggtggactccattaccgaagcatgggcgatggacaacgacgcgccgaagccgtatcaggcgggcacctggggaccggtagcgtccgtggcgatgattacccgtgacggtcgttcgtggaatgagtttgagtaaatttgccactcactcttaggtggtattttaccggtaacatgatctaacacagattgtagaatcatttttgcacttttaagcctcgtgtggattcacctgcgaggctttttttattacactgcctgaaacgattttgccccattatccccggacatcatgtatttcactgtctttccacattgatgaaacgcatggtaaacccggtagccggacagataaatttcaggagcctctatgaatcctaatttgttacgcgtaacacagcgcattgtcgaacgctcgcagcagacccgaaaagcctatcttgcccgcattgagcaggcgaaaaccgccacggtccaccgatctcaactggcctgcggcaacctggcgcatggcttcgccgcctgtcagccagaggacaaagcctcgctgaaaagtatgttgcgcaataatatcgccatcattacctcctacaatgacatgctctctgcgcatcaaccgtatgaacattatccgcagattattcgtcaggccctgcattccgtgaatgcggtaggtcaggtcgcaggcggcgtaccggcaatgtgcgatggcgttacgcaagggcaggatggcatggagttgtcattactcagccgcgaagtgatagcgatgtcggcagcagtaggcctttctcacaatatgtttgacggcgcgttattcctcggcgtatgcgacaaaattgttccggggctggcgatggccgcgctctcttttggtcatttacccgcgatttttgttccgtcaggcccgatggcgagcggcctgccgaataaagaaaaagtccgtattcgtcagctatatgcggaaggaaaagtagacagaatggcgctgctggagtcggaagccgcctcttaccatgcgccgggcacctgtacattttacggcactgccaacaccaaccagatggtggtggagtttatgggaatgcagttgccgggttcctcgtttgtgcatccggatgcgccgctgcgcgaggcattgactgccgctgccgcacgtcaggtaacacgtcttaccggcaacggcaatacgtggatgccgctcggtaaaatgatcgacgaaaaagtcgtggtgaacggcattgtcgcgctgctggctaccggcggttccaccaaccacaccatgcatctggttgcaatggcgcgcgcggcgggcattctgatcaactgggatgacttctcggatttgtcggaagtggttccgttgatggcgcgtctgtacccgaacggtccggcggacattaaccacttccaggcggcgggcggcgtaccggtattgatgcgtgagctgctcaatgccggattgctgcacgaagacgttaatactgtcgcaggcttcggcctgaaacgctatacgctggagccctggctcaacaacggcgagctggactggcgtgaaggcgcggaaaggtcactggataacgatgtcattgcctcttttgataagccgttctctcctcacggcggtactaaggtgctaagcggtaatctggggcgcgcagtaatgaagacgtctgcggtaccggttgaaaaccagatcattgaagcgcctgccatggtatttgaaagtcagcatgatgtgctgcctgcgtttgacgcgggcctgcttgaccgggattgtgtcgttgtcgtgcgtcatcagggaccaaaagcgaatggaatgccagaattacataaactcatgccgccacttggtgtattattggaccgccgtttcaaaatcgcgttagttactgatggacgactttcaggcgcttcgggtaaagtgccttcagctatccacgtaacgccggaagcctacgatggcggcttactggcaaaagtgcgcgatggcgacatcattcgcgtgaatgggcagacaggtgagttaactctgctggtcgacgaggcggaacttgccgctcgtcagcctcatattccggacctgagcgcgtcgcgcgtcggaacggggcgtgagttgtttggcgcgctgcgcgaaaagctgtcgggtgcggagcagggcgcaacctgtatcactttttaagatgacacactagtaatcaggcgagagaagaattccgatgaaaaactggaaaacaagtgcagaagcaatcctgaccaccggcccggttgtcccggtcattgtagtcaataaactggagcacgcggtgccgatggctaaagcgctggtggccgggggcgttcgcgttctggaagtgactttacgtacggcctgcgcgatggatgctattcgcgctatcgctaaagacgtgccggaagcgattgtcggcgccggaaccgttctcaatccgcagcagttggcggaggtgacggaggcgggcgcgcagtttgcgattagcccgggactgactgagccactgctgaaagccgcgacggcaggcactatcccattgattcccggtattagcaccgtttctgaactgatgttgggcatggactatggtctgaaagagttcaaattcttcccggcggaagcgaatggcggcactaaagcgttgcaggcgattgccggtccgttctctcaggtacgtttctgcccaaccggcggcatctctctggcaaactatcgtgactatctggcgctgaaaagcgtgttgtgcatcggcggttcctggctggtgccggccgacgcgctggaagcgggtgattacgatcgcatcaccaaactggcgcgcgaagcggtagaaggcgcgaagcagtaagccgttaaatgcccgatggcgcttgcttatcgggcttacgagtggcgatcaggcaggcctgataaaaatgtgctaacgtcgccatcaggcgatggcgcattagccttttaccgtcacgcggctggcggcctttttcgctcttatcaccgcttcttcaacgttttcacctgtcgctaacgctacaccaagacgacgggtgccgtcgatctcaggcttaccaaacagccgtacctgcactccggcccctaccgccgcgtgtacatcatcaaacgtcacattttgactggtaagctgcggcagaatcacggccgaggcagcgggaccatactggcgaatagcgcctatgggcattcccagaaaggcgcgcacatgcagcgcaaactcagaaagatcctgagaaatcaacgtgaccattccggtatcgtgcgggcgaggggagacttcgctgaaaatgacttcatcgccacagacgaagagttcaacgccgaacagaccatgaccgcctaacgccagtaccacatgacgagcaatctcttgcgcccgcttcagcgccagttcgctcatctgctgtggttgccaggattcgcgatagtcaccatcttgctgacgatgaccgaccggcgcgcagaaatgcacgccatcgacggcgctaacggtgagcagcgtaatttcaaaatcaaatttaaccacgccttccacaatcacgcgacccgcgccagcgcgtccgccctgttgagcatactcccatgcctgcgcgagctgttcggccgagcggataaagctctggcctttgccggaagagctcatgaccggtttgacgatgcaaggaaaacccactgcggctaccgcatcatgaaaactggcctcactgtcggcaaagcgatacgtcgatgtcggcagacctaattcttctgcggccaggcgacggatcccttcgcggttcatcgtgagctgcgttgcacgggcgcaaggcacgacattcagcccttcgccctccagctcgcgcagcgtatcggtggcgatcgcttctatttccggcacgatataatgcggtttttcctctgtaatcacatgacgtagcgcctcgccgtccagcatattaatgacgtgtgaacggtgagccacatgcatggcgggagcatcaggatagcgatcgacggcgataacctcgatccccaggcgttggcattcaatcgccacctcttttcccaattcacctgcccctaataacatcacccgcgttgctgccggacgtagcgcagtgcctaatagcgtcatatttctgtccccttatttacctgcgcgcagtatatacgaaaacgtttgcgtatgtcttttcgaataaattgcttttcttgccgccttgcaatatactgtatataaacacaggtaaataaggggctgcaaaatggcggttgaagttaaatacgtagtcattcgcgagggtgaggagaagatgtcatttaccagtaaaaaggaagccgacgcctgggacaaaatgctcgatactgccgatcttcttgatacctggcttgagcagtcgccagtcgtgctggaagatgggcagcgcgaggcgttgtcgctgtggatggcggaacataaagaggtgttaagcacgatcctcaaaaccggtaagttgccttctccgcaggcggttgaaaaggacgccgcgagtaaaacgaaaaagcaagccgcctgaacccacacttgcgctctcggcgttttgtaccatgcttttcctgaatcattgtgctaaggagaaaagtatgaataaaagaggagcgttgttgagcctgctgttgttatccgccagcgtatcggcatttgcggcatccaccgagagtaaatcggttaagtttccgcagtgcgaagggctggatgccgccgggattgcggcaagcgtgaagcgcgactaccagcaaaatcgtatcgtgcggtgggcagacgaccaaaaaaaggtcgggcaggctgacccggtcgcgtgggttaatgtgcaggacgttgtgggtcaaaatgataaatggaccgttccgctaaccgttcgcggtaaaagcgccgatatccattatcaggtcatcgttgattgcaaagccggcaaggcggaatataagccccgctagcagcgtaatttgcgcttcttttgccggaacagacaattcctgacatcccctcaggtacgcttgaccattattggtctgtatttgaggggtactatggctaactggttgaaccaattacaatcacttcttgggcaaaaaggcgcttctgcatcgccttccggtgaacaggggttaaataaactgctggttcccggcgcgctgggcggtctggctggactgttggtcgccaataagtcttcgcgcaaattattaaccaaatacggtactggcgctttgctggtgggcggcggcgcggtggcgagttccgtattgtggaataagtacaaagataaagtacgcgctgcgcatcagggggagccgcaattcggcagccaaagtacgccgctggatattcgcactgagcgactgatcctagcgctggtttttgctgcaaaaagcgatgggcatattgatgccaaagaacgcgcggcgattgagcaccaactgcgagaatcaggtgtggaagagcaagggcgtgtgtttatcgagaaagctattgagcagccgcttgatccacaacgtctggcacagggcgttcgcaatgaagaagaagccctggaaatctacttcctgagctgcgccgccattgatattgaccactttatggaacgtagctatctgaatgcgttaggagacgcgctaaaaattcctcaggaggttcgggacggtatcgagcaggacttgcagcagcaaaaacaggcgctaccaggctgataacctgccattaagtaacatgtttcgcttgcatcatgcgtgtcttttgccacccttataggatggatagtttacgtcattcatgttgcaagatagcggcgaagcagtgacatctcaggcgcttaccgaggtgagcggaccgggactaccatgctaagccgctgtgtttgccgcgtgatatataacaaatattaacgcaaaagaaaaaacgacatgttgccaaaagccaatcgaattccctatgccatgaccgtacatggcgatacgcgcattgataattattactggctgcgagatgacactcgctcgcagccggaagtccttgattacctgcatcaggaaaatgagtatggccggaaggtcatgtcctctcagcaggcgttacaggaccgcattctaaaagaaattatcgatcgcatcccgcccagagaagtttccgctccgtatgtgaaaaacggctatcgctaccgttatatctatgaacccggctgcgaatatgccatctatcaacgacaatcggcgttaagcgaagagtggaatgtgtgggaaaccttgctcgatgcgaaccagcgggccgcgcacagcgaattttatacgctcggcgggcttgccattacgccggataataccatcatggcgctggcagaagattatttatcccgtcgtcagtatgggttgcgttttcgtaacctcgaaagcggtaactggtatccggaactgctggataacgttgcgcctgaatttgtctgggccaatgattccctgactctttactatgtgcgtaagcataagaagacgctgctgccctatcaggtttggcggcacacgattggcactccgtcatcgcaagatgaactggtatatgaggagaaagacgataccttttatgtcagcctgcataaaaccacttcgcagcattatgtggtgattcatcttgccagcgccaccactagcgaagtgctattacttgacgcggaactggccgatgccgagccgttttcattcttaccgcgccgcaaagaccatgaatatagtctcgatcactatcaacataagttttacctgcgctctaaccggaacggtaaaaactttgggttgtaccgtacccgcgtgcgcaatgaaaacgcctgggaagagctgatccctccgcgcgagcatattatgctggaagggtttaccctgtttaccgactggttagtggtcgaagagcgtcaacgggggcttaccagcctgcggcaaattaaccgtaaaacccgtgaagtgataggcattgcctttgacgatccggcttacgtgacgtggcttgcctataatcccgaacctgagacctcccggctgcgttacggctattcttcaatgacgacgccagataccttgtttgaactggatatggataccggagaacgacgggtacttaaacagacggaagtgcctgggtttgattctggctgttatcagagcgaacacctgtggatcaccgcacgcgacggcgtcgaagtgccggtatcgctggtttatcatcagaagtattttcgtaaagggcaaaatccgcttctggtttacggttacggatcttacggttccagtattgacgccgacttcagcagcagccgactgagcttgctggatcgtggctttgtttacgcaatcgtacacgttcgcggcggcggtgagctggggcagcagtggtatgaagatggcaaattcctcaaaaagcggaatacttttaatgactatcttgatgcctgcgatgccttattaaaactgggttacggttcaccgtcgctgtgttatgggatgggcgggagcgcgggcggaatgctaatgggcgtcgctatcaacgaacgccccgagcttttccacggcgttattgcccaggtgccctttgttgatgtattaaccacgatgctggatgagtcgatcccattaacgacaggggagtttgaagagtgggggaacccgcaggatattgagtattatgactatatgaaaagctatagtccttatgacaatgtcaaagcgcaggactatccgcacctgctggtgacgacaggattgcacgattcccaggtgcaatactgggaaccggcgaagtgggtggcaaaattacgcgagctaaaaacggaccaacgtctgctgctgttatgtacggatatggactccgggcacggtggtaagtcggggcggtttaaatcctacgaaggcgtcgcgctggagttcgcctttttaatcggcctggcgcagggaaccttacatagcgcatagacgcgcgcgcccgcaacggcttgtgagcgtcgcgggttattgtggtgttccattgctgcgttgctcgccagcctgaacatcttccaggtagtgtttaagcgtcaggcgaagttccgggctcatattatcaaggttattaaaaagccagcgtaaatagcccggatcgcgttttgcgacttcagataccgccttaccgcggtatttaccgaacgggaaagtggttaacagcgcaggacggcccgtgatattgaccatctcttccgcggtccagccggtggttcgcataatatcaatcagcaaggcggcggtgatatagcaatcataaagcgcccggtgatggtgcagccccggcggcgtttgtacgcttagtttgcgcgatttatagagcgccatattgctgtattttattcccggccacaggcgtcgcgacaacttcatggtacagatccactcacccggcaattcaggtaatacgcgtctgtcgaaactggcattgtgagcgacataccactcactaccgtaataaagcggtatgacatcttcaatccacggcttatcggcgaccatggcttcggtaatacggtgtatcgccatcgcctgcggcgtaatagggcgatcggggcgtatcaggtgactcatgggattgacaatgttgccatcaatgacatctacagaggctatctctacgatcccgccctgcagcccgcaggtttccgtgtctataatccgcaacatgattcattcctcacccaaagaccttagcgtaatggaatgatatcgccttgccaaccctcggttgtgcgcagacccgtcagtaatagcgaaccgcaatcggcacgaacaataagttgcccgctttcatcccacagcgcgctactgccacaggcattggccatcagtacggccagcgcatatttatgcgaaaaacgttgtaagcgtgaggtagaagcatggagttcaggctcgttaagacattgactggttgtgaataacgtaaatgaggggcctatatcaccaccttctggctgctcatccaccacgttgatagcgcttcgctgcctggcaatacaggcgccatgacttttgtgaaacatgagcggcgacgttagccatggggcaaaaatagcgatgccttttacgaagcggcagttatgctcaacaggcatacccacaatgatagtcatatggtgggtatcggccgcatgagtgagcggctgtaaaagcgcctcgtcaggcggggcgggcaacggtttatttctttcgtcgcagcctaatagcgacagtgacggaaagaccagcagttcgcactgttgacgagccgcaagctcaatatattccagatgatgggcgacatgctctgccggcgaagcgttcaggggcgcgtactgcgcagcggcaattttccaggaggacataatgacttccttttcatagtctctacagccattctaaaaagcataggttaagaatcgccttataatgtagtcgtctgcatgtaaggaagtgtaacgttatataatttttatttaactttgggttcgtaagggagtcgggatagtgatacggaagccagacgatgggcaatcagccgctcgcgaaaccaggcgcgtagatgctctggctgctcacgttcgaccgcctccgcgacaactggcatattgtagcgctctttaaatgccaccccagctgccgccagatccacattgactttatccatttccgcttgttcaagctgagccagattcgttttcatacgtgtctccttttttgttgccgccagaaggtactaagagtccgcggcaatggcaagatggaaatgatgatcctcgactcattgattgttgaaggttattctttgtaacgtaggtataacaaaaaggaatagtgaatatggcttcttctgcaccatcgcgacgtttagctttactgctgctggcatcgacatttgcgacgccagcggcctgggcacatgcgcacctgacgcatcagtatccagcagcgaatgctgccgttacggcctcgccacaggcgctgactctgaacttttttgaagggattgagccaggattcagcggcgcaaccattactggccctcagcaagagtccatcaaaacgcgcccggcaaagcgaaatgaacaggataaaacgcagttgattatcccgcttgagcagccgttaaaatctggcgcttacacggtagactggcacgttgtgtcggtggatggacataaaacaaaagggaaatacaccttcagcgtgaaataaatgatgctgacattcgtctggataactctccgatttattcattttgctagtttgatgctggtctacggctgcgcgctttacggcgcctggctggcacccgcatcaattcgtcgtttaatgacgcgtcgatttttacatctgcaacgacatgccgccgcctggagcgttatcagcgcggcttttatgctggcaattcagggcggactgatgggcggcggctggcccgatgttttttccgtctcggtttggggcgcggtactgcaaacccgctttggcgcggtctggatatggcaaattatcctcgcgctggtcacgctggcggtggtagtcattgcgccggtaaaaatgcaacgacggcttcttattctaaccgttgctcagtttatcctgctggcaggcgttggacatgcgacgatgcgcgatggtgtagcgggaacattacagcaaattaaccatgctctgcatttgctctgtgccgcagcctggtttggcgggctgttgccagtggtttattgtatgcgcatggctcaaggacgctggcgtcaacatgccattagcgccatgatgagtttttctcgttatggtcacttttttgtggcgggcgtattgctcacaggcattggcaacacgctatttatcacgggatttaccgctatctggcagaccacttatggacagttgcttttgttaaaatgtgcgctggtggtgcttatggtagcaattgcgctgacgaatcggtatgttctcgtaccacgtatgcgacaggaaaatccccggactgacctatggtttgtcaggatgacgcaaattgaatggggagttggaggcatagttctggcgatcgtcagcctgtttgcaaccctcgaacctttctgatggactggcataacgaatgaaaaaaatactccttccggcgcttctgctggccacttcgggcgtagcgttggcggcgccgcaggtgattaccgtaagtcgttttgaagtaggaaaagacaagtgggcgtttaatcgggaagaggtcatgttgacctgtcggcctggccaggcgctctatgtgatcaaccccagtactctggtgcagtatcccttgaatgctattgccgagcagcaagtagcggagggtaaaacgcgcgctcagcctattgccatcattcaaatcgataacccggcaaagcccggtgagaaaatgagtctggcgccgtttatcgaacgtgcgcaaaagctttgtgatccatccaatagctgactgatttttaataaaaaaccgtaaaccttcacgaaaaggcttacggtttttttatctctgatgacagacaatacgccaggttttttcaatcaccttcgtcacaaactggaaaacctggcgtcgtcatctattcttaaagagcaaggcgatttagcctgcattaatgccaacttttagcgcacggctctctcccaagagccatttccctggaccgaatacaggaatcgtattcggtctctttttatttcgattataaatcaacgggttatgtgttttccctcgaaatttcctcgaatttctgtattccggtctttttggttatatcacaatcaaattcagtttaacatttcttttacaacaaaatcagagcatcacgtaagctttattatcgcgttcatcgagatagagtttcgtggtgttctctgaggtgtggcccagtagtttttgagcgaattcctcgccgcgttcgtttttgtacagccgaccagccaggctacggatcttgtgaaatgtcggtgggttatcactacatttaacgcctgaaatttttctggcttttacaaatttctttgtcagcccatccgggtgaatattcccggttgggctatttttcctgattccggcactgatcatgaaatcagttcggcttaccagtcggcagcgatcgattaaggcgggcaacggcatagacatgagtaacctgtgcatcttcgttctcacccggacggtgtaccagcttctcttccagaccaaactcgaagctgaaatcgtcaccttcacggacaacgcgcgcggaaaggctggcaatctgtccggaacggcgggcaaggtcgatcattccccggtagccaataattaactgaacgtttttttgcctgacttttcgtttttgtttccgaacggcagcagataggcatgaccgagcgcgccgccgggttccagcccaagctgggaacactgaacgatggcgctgacaaaactcatggtgtcacagtcacccagcgccggaacttttcggatttccgttgtggcataccgccggtacgccgtcaacttgcagcgccgcgtcatccggcagggccaaccccggcacaactgatgatggaaaaattcagacggcgtaaggcggcgggaaggctttaactggggggacttatgagcagaaattacacaccggcgcagaaagctgaaatacaaaagcgcctgacggaactggtacgaacacacggtcggatgacgtttggagaacttcggaagataacagggttaaccatttttacagcccgtcactacctggaaaaggcggaaagttgtggggatctgtatcaggccgggagaagcggtatttttccttcggaacaggctttcctgctttggaagtagaaacgtgaagatgccaggattacccgctttctgaaaacgccggaaggtgtcgtgagttcctacgaccggaccagaaacgttatctgtacggagtgccggaacagcgtgacgatgcaaagggtactggcattttatcggggaaattaccgggaggcgaaatctgcatgaaaatcgaataatataactttgcagaggtagcgaatatcgtaatcatccgtttggcatttgaattccgtgagcacagtcgtgttgtgaatgtcgccttgttcacaacaccaggaatattccactgtcaactggtgtctgcggctggacataattttatctgatattcaggctgtaccagcgcaaaggttccgtgagtccgactgtcttttttgcttccaaatattcagttttaattatctgagtatggcaaggtgatcttctgtatcaaacaccgggcaactggttttactttacccaacgattacgtccctgttgtttagcccgataaagggcctcatccgctctggcaataatgccggtaacagtgtcaccggctgtggaaagggtgatgcccatgctgacggtgaccgtttcgcttaccgcagatgctacatgcggcagtgcggtttcacgcaggtttgtctgaatacgtttagcaaccagtgcagcttcattcagcgacgacgaaggcagcacaacgacaaactcctcgcccccgtaacgtgccaccaggtctgccggagtacgaatcgacctctttactacacaggccacctttgccagacaggcatcgccagcctggtgaccataattgtcgttatagtttttgaaatagtccacatcgagcatgatcagtgcaaacggctccgtctggcggagagcatccccaagaaaactttccattgaacgtcgattagcggtcccggtcagtgcatcctggtgagccataacgtcgagacgcgcgataagcatccggttttcctggtaacgcaaccaggcttcatcaaaccagcgctgcaggataaagcgaccataaatgagtatggcggtaagagtaagccagactaataaaaaccggatattcacatactggttaagctgcacgctggccagtagggcggtcagccataacgggacgatgaaaagtagcaacgctggcagatgataataaagcgcagccagcgcggtaagcataaggatgacactgagaggccaggcaaaaggcagttgccaccagacaataaaacagtagctacaatagctccacatcagactgagaatcagcagcatcaccagacaaagaggagtaaatctggccggaaggcggtaaatgaaaaggagtatcaggaacgaaaaaacaataatactgcccataatatcgtctattaaaggcagtattccagtctgtgcactgatcgacttgtcaaagtcactgatgagtatgtggcgaaataaaatgataagcgcaaagctgatattcacaaatgtgaaccacggaatacttacacgtagcgcttgcctgaccatatctttatgatcctgccatacccttccagcactggaggtacggcgcctgtcgtccgaatcctgccccatccttaatcgcctcatataatgaataattactatccagtgtagtgcggagatacttcatggtgaaaaatggaaaagctatcaggccaggctgcatttttggctgatgagatgatttttgctccacagtgacgaacttatagtcacaattcctgtagtaggggggagaattatagtgtttcccggaaactggaagcgagtttaccccacttactaaaagaggatgtaactggcagacgtaaaacacgacttatttgtatccataaatagcgaaatgtaacgttttggttatatttaaaagagcgaaaatggtcagcaataactttaattgtttgaattaacagataattaatcgaccagactgagtgatacagaatatttttacatgaggggtacaaatgagacttaagtcgatcgttaaaagttttgcgctggcggggctactctcttccactgcgctgacacctttatttgcccaggaagccccaaaaggtgccactgcttcaaccaagcaagctaacaatgcgctttataaccaacttcctttctctgataacaccgatttcacgaatgcccataaaggctttattgctgatttacctgcagaggtgattaagggagagcaagggaatgtcatctggaatccacagcagtacgctttcataaaagaaggggaaaaatctcctgacactgttaaccctagtctgtggcgtcagtcccaactaatcaatatcagtggcttgtttgaagtaacagacggcgtctaccagattcgtaaccttgatttatccaacatgacgattatcgaaggtaaagaggggattacggttgtcgatccgctggtttctgcggaaacagccaaagccggtatggatttgtatttcaaaaaccgtggcaataagcctgttgtcgccatcatttatactcatagccatgttgaccactatggtggtgtgcgtggcgttgtcgatgaagcggacgtgaaatccggcaaggtgaaagtgtatgcgcctgctggctttatggaggcagcagtagccgagaatattatggccggcaacgtgatgagccgccgtgccagctatatgtatggcaacctcctgaaaccagatgcctccggccaggttggcgccggactggggacgaccacctctgcggggacggtgacactgattgcgcccactaatatcattgataaagacggccagaaagaagtgattgatggcctgacttacgactttatgctggcccctggttcggaagccccttcggaaatgctgtggttcatcgaagagaagaaactcatcgaagccgcagaggacgtcactcacaccctgcataacacttactcgctacgcggcgcaaaaattcgtgagccgttgccgtggtcgaaatatatcaacgaagctatagtgcgttggggtgacaaagctgaaattattatggcccagcaccactggccgacttggggtaacgagaatgttgttggtctgctgaaaagccagcgagacctgtatcgttatatcaatgaccagactctgcgtatggccaatgaaggtctgactcgcgacgaaatagcggccaacttcaaactaccggatagcctggcaaaaacctgggccaaccgcggctattacggctccatcagccatgacgtaaaagcaacgtatgtgctgtatctcggttggttcgatggcaatccggcaacccttgatgagctgccacccgaagaagcggctaagaaatttgttgaatatatgggcggtgccgatgcgattcttcagaaagccaaagcagactttgaccaggggaactaccgttgggttgctcaggtggtgagtaaggtcgtgtttgccgatccaaataaccagaatgcacgtaaccttgaagccgatgcgttggaacaattggggtatcaggctgaatctggtccatggcgtaacttctacctgaccggtgcgcaggagctgcgtaacggtgtggttaaaggtccgacgccaaatacagcaagtccggataccgttcgggcaatgacccctgaaatgttcttcgatttcctggctgtacatatcaacggtgaaaaagcgggtaatgcccgggcggtgtttaatattgaccttggcagcgacggcggaaagtacaagcttgagctggaaaatggcgtgctgaaccacacggctaatgctgaagcgaaagacgctgatgccacgattactctgaaccgtgacacgctgaataaaattatcctgaaggaagaaactctgaagcaggctcaagataaaggagaagtcaacgttaccggtaatgctgcgaaactggatgagatgctgggctatatggacaagtttgagttctggttcaatatagttacaccataaatagattccctgcggcgtcaatgctgcagggaagttacttcagacaattctgtacgtttttcatactcgatttttccttcattctttatatcttgcttcattttatgtatttgctgctgaagcacatgaccctgatgccagtcagtcctgattctgttatgcacagcctttttcatcagatgacagtaactggttgttgcgtgattcaatggtctgcgagtctggtcaacatgcttttagttagttaaatgtgattctactaattcgtaatgcgaaggttataagtttgattcctattattgcaccatttcaacgttactgaaacttccgtgttagcccataaccattccagtttctacaagacaggtgcttgctatatatttaccaatcagtcattttaaaagtgcgtcataaccggagaactgtcctcgtcaggaggcctgttttcagaaaggcaatatcctgcttcgacagtagcttatatgtgaccgggttagcagcacattcccctccgccacattccagtacagttgaaataaggttggcagtaatcagtaatagaaatacccaaccgacaatactgaacaggttcggattaatattcaatgaacgaaatgcagcattcatgctactgattgccagaactaccgcaacagcaataataatgagaattgacgtaatcagagtccaggtataaaagtgtaatccaaaaaatgcagaaccatatcctgtgtcaccgggcatgatatgcaaacatatttgccgggatgccataactccggtcaggatactgccaataattaccatcccgtaatgtatgcctcgtagaccaaagcagaggttaaataaaaagccaaaaccggcgatgatgaggccagcccgctgtaataagcaaattggacaaggcagctcatgcctaacgagttgataataaaaggctacaaccagagcaacgcatatcccaaggagtcctatctgattaatcagatgaacaaatgttgttggatgatgatgcgttttcatacacactccttaaaatgacaaagttagcgaattggtcatatgatggatgaatgataaaatagtgacgatgagtaaaacggcccatagaatgtagctgactttatcctttctgtttatggctcccattgccacgctcagtgcaagcaagaatggcagaaacatgaacataaaaaactcctttattacattgcttgttaatataatcgctgtgtattaccgggtctgtattccagcttatccaccccgcattagctggagctcagtaaggcatcaggaattatttgcgttattataaatcgattatttctgtgatgaattatcccgacatctgctggttacagggatatttctggcgacaagagtaagaaatatcccgatagctaatggtataataagcagcattgagtgtgttgaaatagcatatccataaatatagtcttccagacttaccgcaatcagcggaaagataagaaatacaagcgaagcctggaaggcgttagccttttgctgaagcgcaaagtagcacaggataccaaaaactccggcaaaagccccgagatacagggtagctaatattgagtgtactgagaaggttgatacttgtggtctttcaaaaaaccatcctgtcgcagaaagtatcaacccagctaaaaggcacgggagcgcattaaatgtgataacagagacagtacaacttcttttcttacattgtgtatatattatggcatggattaacacagcagaaataagcgcagtgataccctgccagtgactctctgtacttgtattcgtttcttcaagaagtatccccgtcaatgcagtgattgcgatagttaagcccgcgatctgcattagtttcgctttttcatttagaaacaaaaccgatgctatcaaaacggccacaggcatattcgcaaagataatggcggcaagcccagagttgacataggtttcaccataaatcattagtgagaaaggaatagaaaaataaaagatgcaaatcacaaactggaataatcgttgtccgggaggaaacaacaggtttttttttcttaaccatgcaatgatgattaaaaaaggtgctgcaaacataaacctcattccggttgcaaacactggagggatagtttcaacggcaattcgcatagccaaccatgtagtcccccaggtcagtgaaactagcatgaataatatagatatcgacaccttgcgcataagatcctctccataaaaaaattaatttagctttttagctagaaaaaagtagcgttttcttcactgtgttttttatatgtttagataaaaatttctctatcagaagacgcagttatgctgaatgagaaaaataagaaatgactcaggctgttaccacacgattgtccactgcgcctgcaagacctggcagcagttgtcgatttaatatctattcttgctggaaggcataaaacgccttgaagatgaagagctcatcattagtcgggttcccttgttgagccaggacaagtttaacttatcgctttcaacccttacgatgataaatgatcttatccacccataatggacatacggctaaatgagtaaattctcaagtaagaggcaggatctgtatcaaccagtaagaagtcccggaaacagcaccggcggaattccgtcaggaagctctgaaactcgctgaatgtacgttgcccgcgaacgattgttaatcagcgctatagcaagaataattgtttgtttcacaaggagatagaaaaactatagctttgcgccggggcggaggcaggaggagataactcgttgtaatagaatgtttttatatggcgaccttaagagaaatgctttcgcctcggtataccacccgctatgaagacctgcttcaggttaagtggcaggtttatccagattttcacattcctgatgtgatggaaccgcagccacatcgtatgcaagaacgggctgcggcaagctggcgatcgttcgatagtgcgagtattgaatggctgccagttgcggcggattttacttgttcaggatgactaaccaatgtgtttaatctgaaactagccacctgttcaacttttcgcgatcgcttttgttggcatcactattaagccttcgtctacatgggtatttggcatcgggagtcccccaatggaagaggggagtgatgtattgggcagtgagtttgtttggtcgggagatttatacgcaaaatggcccgaaatacgtccgaattaaaacgtaaaaagtgataactaattgaatctattagaatcaaaaataacgtgttctaatcgttaaaatcacctaattaatatgtaacattatgaatttaaagggaaagatcaattgttgccgtaaacaggaatcgtattcggtctctttttgtttttcttataaatcagttgcttatgatcaataatccgaaatttccgaaattttccagaatttctgtattccgggctttttcgttatatcagatccaaatccagtttaacatttcttttacagcaaaatcagagcatcacgtaagctttattatcgcgtttgtcgatatagagtttcgtggtgttctcggaagtatgtcccaggagtttctgagcaaacccttccccgtaagcatctttatatagtcgtccggataagctgcggatctcgtgaaatgtcggtgggttatcactaaatttattccggtaaattttcgtgccgcaacaaattttttagtcaggctgtcaggatgaatactcccgttcgggcggtttttgcgtatgccagcgctgataaggtattcgctacggcttaccaggcggcaacgatcaatcaccgtactgaggcgtaaacccatggaaggaggggtgagcgaaagtggcagagcgattttcatctcggtcttgattggcttaacgtacagtcgctcatcaataatgtgactgaactgagactgtaattaaaattgtgtaattgcctgtttttgatatgttcactccagtaacggagacaggcaattatggacgaaaagaaactcaaattccttgcggctgaactggctaaaggccttaaaaccgaagccgacctcaatccgttttcccgtatgctgacgaaattaaccgtcgaaacggcgctcaatgcgtagctgactgaccaccccgggtatgagaaaaacgcccccaaaacaggctcaaacacccgcaatggctactcgtcaaaaacggtgttatgcgatgacggcgagatcgaactgaacacgccgcgtgaccgtgaaaacaccttcgaaccgcagctacttaagaagcaccagacgcgcattacgcagatggacagccaaattttatccctctacgccaaaggcatgactacccgcgaaatcgtcgccacctccaaagagatgtacgacgccgatgtgtcaccttcgctgatatctaaagtcaccgacgccgtaaaagagcaggtcactgagaggcaaaaccggcaactggatgcgctgtaccccattgtttatatggactgcgttgtcgtcaaagtccgtcagaatggcagcgtaatcaacaaagccgtcttcctggcactgggtatcaacaccgaacgccagaaagagttactgggtatgtggctggccgaaaatgaatgcgaaaagttctggctaagcgtgctgacggagctgaaaacccggggccttcaggacatcctgattgcctgtgtggatggtctgaagggcttcccggatgcgataaatagcgtcttcccgcaaacccatattcagctgtgcagtatccatatgatgcgtaacagcctgaaatacgtagcctggaaagactacaaagccgtcaccagcggccggaagatggtctatcaggccccgaccgaagatgcggtactgatggcgatagatgcgttcgcgaaagtccgggacgataaatatccgcaaatcagcaaaagctggcgtgcgcaccgggaaaacctcaatacgctcttcagttatccgccggatatccgcaaggccatctacacgacaaacgcagtcgaatccctgaacagcgtgatccgtgccgcgataaagaaatgcaaggtgttcccgacggatgactcagtacgaaaagttatttatctggcgatcaaggatgcgtcaaaaaatggagtataccgctccagagctggtggctggcgatgagccgttttattatcgggttcggtgaccgcctgatgctgataattttagtcgtgaggttctttcttctgcaccgggtgggcgcatttcataactgcaggaccatttgctgaatactgtatagtccagtactttgcatgttgttgagatcagtgtgcaattcctcggtactggcttgttctgtataggtctggagatttctgggtagtgtccttgtggacctgaacatatgtttttgattgaaaatggcatcgtgttttatcatttacgctgtgaaatgttgttttgtgctcttctgttgtgattggtgatgtgacgggatcgtccatgcacccttccttttattgacggcgtatcagtccattgatgccatgctcgcttaatttgtccagcatcatcaagccgtcgttttctttctgctgcaattcaagcaacttaaaccgtatttcgttaagtaaaggtttaataactccgcgcttgcgaaccacctttctgataacgtctttttcgaagtataaacggcagaagtgattttcataattcgcctacactcttcacccagcgctggcaaatcttcaacgctgaaaggctggggagaaaggcgtccagttgctgaacggagagcgtaccaaacgccctgattccacgcgttatcaaacttcataccgtggtcatcatccagacaaggcgcttgaggttgcacatatcttttggggaaagaggttcggcggtggatactggatatcctggatcgggaagtgggttccactggtgccaaatacagtgggctggtaaaccgggtggatacctcaaatcctgacaggccagagtatcagcctgataaaatcgtattactgatttctaaccagtggcacattaattgtaccagctcagactccaactgacagtttgctttaagcgagtagcggacgtgacctgccccgcaggagtaaaaataaactttctattgatacatttaattaacttatttataacgttatattccaaatgcaaacttgttcaattggatatgtatggacattcaaattacacatcaagttactgaatttgataaagaagaactattagccggattaagaagctacaatgctcagttcgtcgattttagtaaaaatgggcagcttggggtctactgcagaaacgaaagcggcgaaatggtaggcggattaattgctgacagaaaaggtccgtggctttgcatcgactatctttgggtaagtgaatctgcaaggagccgcggtctggggagtcaacttatggagatggccgaaaaagaaggtttgcggaaaggctgtgttcatggacttgtagatacctttagcttccaggctctccctttttatgaaaaacagggtcatatacttcaaatgtcgctaccggactttcctaaagtaggttcgcaaaggcattatttaattaagcctgatttatagctttgctacatttgaatacccatagccttatgaaagctgcaatcaggtagctttaaaatatatcgtattgttggcctgtacacaccatgttcagcgtccgcttctggcgcagggcggacagtcagattaggtttggcgctgtgccatagatatgtcagctcacatttgagctaataccccctggcacggctagaggtactcagacagccgcttgtaggcggcatggtacggatacaaaaacatatagcgctgttatataaactgtaaactgggctgtgcgtataatacgaatctttcactcagagaaacctgctgacagcgttagtgctccattaattaattttgtactaaatctctgtggtatggcacagacgtttagaagacaggtcaattgcgagctgctggctgggatttcgtcgcgccactcaaaaatgcacagagtttttcacccgccgtcaatggctcaatgggcgtttttccgagggcggtctcagtcatgacgatggcaggaccaataagcatggaccatacttcgctcgcgtcttgctcaagcgatgtgaaggcaaggaacagtgtcttatctgaaggaaagcggtgctgagtattaaaaagtttcagccaggcgcgggactgccggtcggcctgtgttgagcgcgtgccgaagcggagtactctttttagtatggcgatacccacaatgcctggccccagaataaagggactcccgacgtttatggtgacgccgaccccgagaaaaacgagggcgaatgacagcacgttatctactcttctggtaagagtactgtatagtttttccagagagtaccggtaaagaatttgataactgatttcatctttgctcatacatctccagatggtttttcgattacgctccggtatgctcccggaatcctgacagattctgcaattatgccacacttcctggagagtattaattagatagaatataaatagcaggcaaatattttgagcttttagtcgatatcgctttgaatatcatttctcctgcaccaggagatgctgttgtcgagcatcgtgtcaaacgttgctgcgtcggtcggactgcacaggataactctcgcagtcagactctcattatggtctctaaatggataacccgcagtcgcaacacgccggatgtcacgactgacgctattattacccaggtttgttaaagcggcatgaccacattttctatatataataattggttgtctttcgaccagtattgtcgagtttttttgtttaattccacaatccatttaaaaacgcctgccgttgccagatcggtacagtatttttcataggaatgctcgcccgaaaagtgtttagctgaagtcaattttattaattgcgtatttggtgttgaattgactttaatcagctttctattgcttttaatagaaatgaaatggcctgcatgagtgataattttcacattaccggtagcaacaaaatagatgtaataagcgatattattatattccagatcgattagaaatgcgttgaaatttgcatcctttctgacacgctcgaaaaagtggttaagcataagctgtaattccatttgttaacctattgtaagttataatgttgaatgttgtgttagagtattgttgtttaaaagcagctatacagatatgctacctaaaagcaataataatcgtctggtatcatatagtttacgttatgattggaatagtgttgcaattgttactgattatttctcgtagcgcgtttttttgaccactaatagatgagtcaatccatttcatttgtagtttttctgaacgccatgaaaagtcataatatataaaaatcagttaattaattgatttttagataaggattacagtggcggagaggtttggcgtggcgactttataggttttgaaaaagcggctaactcgctggcaggataattggtagccagcctgcgaatgggggcaaaatcgtaacaacatcagcataaataataatgttcatgaatgttttgtgtgacgcagcagttgaattgaagtgatgttttgcctgttcaggattgtcccgataaaaatgttcctcgataaaagtcgatcaccttgcgccgaaaaaaaacaggctaagtgacagaagaacaaaatccatcaggaaaataaaatttataaatatcaatgagtaaaaatggttgtggagaaggtggctattttttgaaagcaagaaatataaacaaagtgtagctatgcatagttatctaaaaggagaactaccgtgactaacataacactatccacccagcactacagaatccatagaagtgacgttgaaccagtaaaagaaaaacaacggagaaggacatttttgcaaaaagtattactgccgttagaaatagctttatcagcctgtcgacgagtctgtcagatcgttttagcctgcatcaacaaacagacataccgactacccattttcatcgtgggagcgcctctgagggtagggcagtattaaccagtaaaactgttaaagattttatgctgcaaaagctcaatagcctggatatcaaaggtaatgcgagtaaagatccggcctatgctcgtcagacatgcgaagccatattatcagccgtgtacagtaataataaagatcactgttgtaaattactcatcagtaaaggggtcagtattaccccctttctgaaagagataggagaggctgcgcagaatgcggggctacctagggagataaaaaatggtgtatttactccaggtggggcaggggcgaatccttttgtcgtccccctcattgctgcagcgagcattaaatatccgcatatgtttataaatcataatcagcaggtgtcttttaaagcgtatgctgagaaaatcgttatgaaagaggttacgccgctgtttaataaggggacgatgccgacgccacaacaatttcagttaactatagaaaatattgcgaataagcatcttcagaatgcctcctgaagatagcaaacacaataccgctattaaccgtatgaattaatagcagattttctgaaactatatattcatttttatggcgacgcttttaacaaaacgtcgtcatatttattttaatataaaaatcaaatggatacacttaaaacttaaaataattgttattactctaaatgccggtataaccagacagctttttttgaaacgctgcgtgttgttaagtctatgatacccgcgcacggatgatgtctcgataaggattaatggtctgttaactgtcaggagaggttatgccacctttaaaaaaaattgtgctgcgcctgtttgtgggggcgatggtcgccacggtaacgacacctgcattggcgctggtttgccttgaggatcactccgctaaagagtgtgctatatcgtgtgctgaggtgatgtggtttatgtttccgatatgtttttaaggagggagaatattgaacgcgaacaggtgatagtgagtagctcgctgcgccaggggataacactcccctggtgcagtcagttatattttattgcgatgataacaaagcatttactcgctactgatgaaattcgctatttacaacagagcacgtttactaagcaagaaaatctgcacacgctatctttttatatctatcttggataatgaacgacaggaaaaacatgatgcggcctgaagagatttatcagcgaatagaggcaaagaattggcggcatgtctgggtggtcggcgatattcacggctgtttttcaatgttaatgaaaaggttacgtgagtgtcaatttgatccgcaacaagacttgttagtttctgtgggcgatctcattgatagaggcccggacagcctgggttgcctggctttactgcgtgagtcctggatgacggcggttcgcggcaatcatgaacaaatggcgctggatgcgcgggcctcatcgcagtcgacgctgtggttgatgaatggtggcgactggtttacccgcctgacggctgaacacgctgcgcaagctgaagcgctttttattctttgtcagcggctgccctggatactggaagttcgctgccgccatagcacgcatgtgatcgctcatgcagattatccagcgtcaacctatcaatggcaaaaaaaggtcgacttacatcaggttctctggagccgcgaacggctcataaataagcgcggcgggattagcggagccgatcatttttggtttggccatacgccgttgcgtcggcgcatggatttcgccaacatacactatattgatacgggcgcggtatttggcgggcaattgacgttagcgcggatacaatagcggcatcagcgactagggttaaaaatcgctatattgctgcgcaggtcgccagaagccgtcgataaaatcctctaccggaaaacagccgccatggcgaatccgttgatcgtccatcgaataaagacactgctgctcggtatcgtagatgtccacgacaatatcctcgcatcctccatccaggtaacatacaaaaagtaccagcgcgaacattacatcctcaatgttaactactttacacgatagtgtaggagaggttagcgcaggggggaaatgagaaaaggaagaataaataacccgcctggcgacgggttctttttgagtcaggcaagacgcatgacccaggcatcagatttaggatcgtaatgattacggaacaaaacggaatgttccccgttgagaatggcgggaacgctggtttcggcatcccaggcgtccagttgcatacataaatccggatcggatttacaggggattgttaacgttcgctcccccggcgattcgccatgtaattcggcatcgtcgatttcaaaagcgccaatgcgcacactggttttcatcatcgtgctctccgttaatacgctaattgtggtacgaccagtttagccgtccatttttcagcgtagtcaacgtacgcaaaagcgccagtcaaaaagtgcggtttttttgtgcgccttttaactattaccagtaaagagttttccatcccgcaccagttcacgcgggtaactgttctttattctggcgccgatacgttttgccagaccaagtggctgatgctggaacgtcaccaggacatcatcagcggcagggggtgtttgcggataaatatcccgaccgcgataccactcctccgcctcttgcacagaaagttcgaacgcgtgagcatgagtcgggcaggcaagggctatcgtcgcctcatgttgccagcgatagcctttattatgactttcggccagcttaatgccgagccgggaaaaacggacttttccgatcagtgattcaatctctgccgggaacagccagacctctttttcacgctgccaaagatggagattttcatcccatagcagtccgacggcgttggccgcctgggtaacgtttaatgcttcgcggcctttgagggaggtaaaaggaaacgcccccactttataccccggcgcgggcatggctggaagggatgacattttacgcagacgtgcgacgaagaatccttcgcagtcgtaaatttgcgggaagacgtgcaggaagccttccggggtgagggcgcggtcagcgtcaggaaacagatcacccagcggcaaaaattcaacggcgtcggcgtaggtctctttcagccagaggcagaccgcttcgttttcctggcgatttaacgtgcaggtggagtagaccagcgtgccgccgggtcgtaaagcatgaaaagcgctgtcgagcagttcccgctgtgtcgccgcgatatccagattactttctggcgaccagttttttagcgcatcaggatctttacgtactacgccttcgccagagcagggcgcatccagcaggatagcgtcaaacatctccggtaacgcagcgccaaatacgcggccatcgaaatgcgtcagtgcggtattggcgattccacatcggctgatattagcgtgcagaactttgacgcggctggccgaaaattcgttggccagaatggcgccgcggttccccatgcgggcagcgatctgcgtggttttggagccaggcgccgctgccatatccatgacccgctgcggatgattatcatcggcgaacagggccgcgaccggcagcatcgaactggcctcctgaatgtaaaacaggccgcttaaatgctcagcggtactgccaagcggcaatgcctcttcatcatcgcgctcgatccagaatccttcatgacaccacggaattggcgtgagcgaccagccgtagggcgcgattagggcaaggaaatcagccacggatattttaagcgtattgatgcgtatactgcggcgcaacgggcgttggcaggccgaaataaattcatcaaaagagagcgtggaaggcattgcttcacgcatttgcgtcagaaaagcgtcaggaaaatagacagcgtgttgagccacaggtgtatcgccggcaaaaaaacaggcgcgcagtgtagcataaaacgctccggcgcgagtacgccggagcctggtgtttaacgtggcagagcggtaccccattcacgccactctttcggttcgctctcttgtaacaggaaatgcttaccggcttgcgcttttggcgccagcggcgtacctggtggagtagcgaaggcgataccgccacggatgaattgattaaatgtccccgttttcaccacgccgcctgtcagaccaaagtcgagactatagccggaggcaagccagaatacggagttattacgcaccagatattggtaacgcttactgatgcgcaaggtgatcatcacgcgatcggagagcgaccccagggacattccggtgacggttcccacttcgataccgcgaaacaggacgggtgtgccaatattaagcgagcctgcttctggcgcctccacgacgatgcttaacccatccagatagcgtgagtcggtaatcgtggcttcctgcagttcaaagtcgcgccgcgccgcgccgcgtcctggctcaacgttaatatagggctggagaatcgtatccagatgctcgacgcccgccgcggagatttgtggcgtaataacggaaaaacgtgtcccggcgcgggcaaatgtttgcacgtactccggataaagtacggcttttgcctgcacttcattacgtgcggtgatcaattccagcgtctggatctggccgatatcaataccgaggtaacgaatgggcatcccctccgccaattttccggcgtcgaacgcgtgtagcgtaatttgtccgcctaccgcgcgggcggaagtttctgaagcataaagaatgcgtttatcgcctttgcgccgactggcgctggcgccgctcaggttatcaaaactaatggcccctttcagcgcacgggagagtggcgaggcctgtaccgttaggccgctgccgttaagttgcaccttcgcgccgccttccgcccagaacacgctattgctggttaacaggtggcgatattccggcttaatatgcaggtcgatgtcaaaggtattggcgcgtgggcgaacggtgatgacttcgcctacttcaaattttcgatacagcacgacggaacctgcctggacatccggcaacgtttcggccgtcagcgtcagggtggtagtcggtaagtcactgaggctattttccagcgctttttccaggttagcatagagcgggtaggtggatttcatcttcccgctcgtaccgggtaaaatacgaattccgccgtcaatccactcgctggcgctggcgccgaggaactctacgccgtcaaggccgactttgacatccacccggctgttgaccacgaatttactgtcgccctgtaccaaatcccggtgctgcggttcaatcgcgacgatgaatgacacgcctttactggataagttgcgctcaatgacctggccaatttttacgccatgtaaaattaacggctggcccggttcgatgccgtaactttccggggccgtcagcgtcagggttaaggcattcgcctcatgcagcagggctttttcacccggcaccaccacaaattcactgcgtggttcgccgtcgcccggcaccagctcgaaggtttttccggttaacaacgaactgatattcgcgtcacttagcgacagtttgggattgcgtaactcaatacgcgtattttcccgcatcagcggaacaacgctgggatcgacggtcatctctccggtgactttgccgccagggttgagcgtcagtttagaaagctcacccacctccagtccctggtacattagcggcgtagattccgctttcagaccgtctccgctgggcagctcaagtttaacgattacccctcgttggctgtgggctaaatctttatataagccgaacgtgtcatcctgggcggcgggtttggaattgtccggtgagtcaaacgcaatcgcgccattgaccagggccgcgaggctctccagtttcaccttcgcgccgctcaggcttagatcggcgtcaatgccggagacattccaaaaacggctgccttttttcaccagatcggtaaaccgtcgctcaatcagaacgtcaatcgtcacgccctgtttgttagggttaatcgaatagtcatacacccgtccgacagggattttacggaaatagaccagtgaaccgctattaagcgaaccgagatccggcgcattgagatgaatcatcagatcgccgttgctaagccggtatttaggctgtgtatctagggcgacgaaatgatctctgggcttgcctttacctggcatcataccgatgtaattcccgccgaccaacgcatccaggccggaaacgcccgccagcgaggctttgggcgtcaccagccagaattgcgtctcttcgcgcaacgcatcttccatatctgatttgatactgacgcgaacttcaattttgcgcagatctttgctcagactgacatcttccacggtgccgacttctactccctgataacgcacgggagtacggcccggtacgataccgtccgccgacataaaatcgatagtcacgctattgccgcgatcctggtagctatcccataccagccaccccgcgatcattagcgcgataagcggtagcagccagaaaggtgaaatacggcgtttggttttaatttgcgcttcagtcttcgaagcgggcgtttcctgactcatgtgcatcccaaagtaagcggctatccagccattccactgcaagaatagtcaaaattaccgctgcgccgaaataaaacgcagccggtcccatagtaaaagccagaatctgatcgcgattaatcagagacatggttaacgagataacgaaaagatccagcatcgaccagcggcctatccatgtcaccagacgcagcaacagaattcgcgtccgcagtccctgttggcatttaaaatggatactcaacagtagcgtaaacatcacgatgactttggtaaacggcaccaaaatactggcgataaaaacgacggcggcgacggcgatattgctgctggcaagcgacataatgcccgacaggatagtatcttcctgacgcccgccattaatgtagattaccgagataggcagcaggtttgccggcagcaaaaagacaatagacgccagcaaggccgcccaacacttctgtatgctctgttttctgcgtaaccgtagcggaatatgacaacgcgggcagcgtcctttcgcatccggatagccgctaaagtggcagccaagacagacgcgcaatctttcgtccgcacgttgagcagggtgctgcggataaaatcgttcccatagttgctccacattcagatgaatcatagtcagaatgctaagaaccaccaacgagacgaacgctaaaagcccaatgcccggctgcagaaaggcatagtcctgcactttgatagaggcaacgccaataccgaccagatagatgtccagcatcacccactctttcagtttttccagcatcagcaggactggacgcagattcatgccgagaaggctgccaaaccacaggtaagcaattgaaaaaaccagaataagcggcgcgcccaccacgcaaaagagcaccattgcggcggttaacggatcgccctgctgcgtcatttgccagatgccgtgcatcacattggcatcaatgcgtacgcccaacaggtagatatggagtagcggttcactccaggcaaacggcatcaatagcagcatggttactgccatcgcggtcagccgcgtcagcgaccagtcgcgcccatcgcgaattttggcctggcaacgaggacaataagcgctttgatgagcgctcatctccggcaagctgaacagcatgtcgcattcagggcagcgctggtagtggctgcgcggcagcgcttcgctaactgacctgatcgttagcttttttgttggcgtgacgtgtgaggtgttcagagccatgtatcgtgaatcaaagtgttagaataatgtaatcttaactcatgacaggaataatcttgaacaagaacgcatttaatgcttattttaatagcctgtgtttaggagtaagaccacgaagtgattatataatgagcaaaacagaactatacgcggcgttaaaccgcgattttcagtcgttaatggcaggtgaaaccagctttctggccacgctggcgaataccagcgcgctactgttcgaacgtcttaccgaggtgaactgggcgggattttatctcctcgaaggcgatacgctggtgttggggccgtttcaggggcgaatcgcctgtgtgcggattccggttggtcgcggcgtgtgcggcgcagcggtagcgcagaataaggttcaacgtattgatgatgttcatgcgtttgacggccatattgcctgtgatgccgccagcaacgccgaaattgtgctgcctgtcacggttggcgaacggattatcggcgtgctggatatagatagcacggcgtttggccgttttaccgaagaagatgaacacggcctgcgtacgctggtcgcacagcttgaaaccgtgcttgcaacgacggattacaaaaaattctttgcgagcgtcgcaggataatcaacggataacgtagcaattactgatagcgtcattataatgacgcctgttcatgcctgctgcttgttggctacgtccgttgtaatcaggaaatttcatggaaaatcaacctaagttgaatagcagtaaagaagttatcgcgtttctggccgagcgttttcctcactgttttagtgcggaaggcgaagctcgcccgctgaaaattggtatttttcaggatctggtagagcgagttgggggcgaaatgaacctcagcaaaacgcaacttcgttccgctttacgtctttatacttcaagctggcgttacctgtacggcgttaagccgggcgcaacgcgcgtcgaccttgatggcaatccgtgcggcgagctggaagaacagcatgtcgaacatgcgcgtaagcagcttgaagaagccaaagcccgtgttcaggcgcagcgcgcagagcagcaagcgaaaaaacgcgaagctgccgcggcggctggcgaaaaagaagacgcgccgcgacgcgagcgtaaacctcgcccggtagcgcgtcgtaaagaaggcgctgaacgtaaacctcgcgctgataaaccgacgacgaaagcgccgcgtgcgcctcgcgaagagaagcacacgccggtttctgatatttcagtattgaccgtagggcagtccctcaaggtgaaagcgggtaataatgcgatggatgccaccgtattagaaattaccaaagatggtgtccgtgtacagctgaattcgggtatgtctttgattgtacgcgcagaacacctggtgttctgaaacggaggccaggcctggcatgaacactttttttaggcttaccgcgttagctggcctgcttgcattagcaggccagtccttcgccgtggaagatattacgcgtgccgatcaaattcccgtactaaaggaagagacgcaacatgcgacggtgagcgagcgcgtaacgtcgcgttttacccgctcccactatcgccagttcgatctggatgaggcattttcggcaaagatttttgatcgctatctgaatcttctcgactatagccacaacgttttgttggcgagcgatgtcgagcagtttgcgaaaaagaaaaccgtgttgggcgatgagctgcgcacgggtaagctggatgttttttacgatctttataacctggcgcaaaagcgccggtttgaacgttaccagtacgcgctaaaagtgctggaacggccaatggatttcaccggaaacgatacgtttaacctggaccgcagtaaagcgccctggccgaaagatgaggctgagctaaatgcgctgtgggatggtaaagtgaaattcgatgagctcagtctgaaactcaccggcaagagcgacaaagaaattcgcgaaacgctgacgcgtcgctacaaattcgctattcgccgcctggcgcagaccaacagtgaagatgtgttctcgctggcgatgaccgcttttgcgcgtgaaatcgacccgcatacgaattatctttctccccgcaataccgagcagtttaataccgaaatgagcctgtctctggaaggtatcggcgcggtgctgcaaatggatgacgattacactgtcattaactcattggtcgccggtggcccggcagcgaagagcaagtcgattagcgtcggcgatcgtatcgtcggcgtagggcaggccggaaaaccgatggtcgacgtcattggctggcgtcttgacgatgtggtggcgctgatcaaagggccgaaaggcagcaaggtccgactggaaatactgccggctggcaaagggacgaaaacgcgtattatcacgctgacgcgtgaacggattcgtcttgaagatcgcgcggttaaaatgtcggtgaaaaccatcggcaaggaaaaagttggcgtactggatattccaggcttctatgttggcttgaccgatgatgtcaaagttcagcttcagaagctggaaaaacagaatgttaacagcatcgttatcaatctgcgttcaaacggcggtggggcgctgacggaagccgtttcgctttccggcctgtttatcccttctggtccgatagttcaggtgcgcgacaataacggtaaagtgcgtgaggatagcgacaccgacggcgtggtctactacaaaggcccgctggtggtgctggtcgatcgtttcagtgcttcggcatcggaaatcttcgctgccgcgatgcaggattatggtcgcgcgctgattgtcggtgagccgaccttcggtaaagggacggtacagcaatatcgttcgctaaaccgaatttacgatcagatgctccgcccggaatggcctgcgctgggttcggtgcagtacaccattcagaagttttaccgtgtcaacggcggtagtacgcagcgtaaaggggtcacgccggatatcatcatgccgactggcaatgaagagacggaaaccggagaaaaatttgaagataacgccttgccgtgggatagcattgatgcggcgaaatacgtgaaatcggacgatttggccccgtttggcccggaattattgaaagagcacaacgcgcgtatcgccaaagatcctgagtttcagtacatcatgaaggatatcgcacgtttcaatgccatgaaggataagcgcaacatcgtctctctgaattatgcgcagcgtgagaaagagaacaatgaagaagacgctctgcgtctggcgcgtattaacgatcggtttaaacgtgagggtaaaccgttgttgaagaaactggacgatctgccaaaggattaccaggagccggacccgtaccttgatgaaacggtgaagattgctctggacctggcgcatcttgaaaaagaaaaaccagcggagcaagcggcaaccgataagtaacgctaaacaggcacaaaaaattgtgcctgttttttttaacaagcgcagaagtcgtcaggataatgctacaaaatgtaaagttgtgtttttctcgtgacttaccgcctggtgatacttgaaaatagccataagacccatacgatgtgggtaatcgcatagtgcgctttgttaaattgaggttaaaagaaaattatgatgcgaatcgcgctcttcctgctgacgaacctggccgtgatggtcgttttcgggctggttctgagcctgacagggatacagtcgagcagcgtgcaaggcttgctgatcatggcgctgctgtttggttttggcggttcttttatttcattgctgatgtccaaatggatggcgttaaaatccgtaggaggggaagttattgaacagcctcgcaatgaaagagaacgctggttgatgaacaccgtagcaacgcaagcgcgccaggctggtatcgccatgccgcaggttgctatctaccatgcgccggacattaacgcgtttgcgacgggcgcacgccgtgacgcctcattggtcgctgtgagcaccggtctgttgcaaaatatgagccctgacgaggcggaagccgtcattgcgcatgaaatcagccatattgccaatggcgatatggtgacgatgacgttgattcagggggtggttaacaccttcgttatctttatttcgcgcattatcgcgcaaattgctgctggttttctgggcggcaaccgtgatgaaggcgaaggaagtaacggtaatccgctaatctatttcgccgttgcgacggtgctggaactggtcttcggtattctggcaagcattatcaccatgtggttctcccgttaccgtgagtttcatgccgatgcgggatcggcgaagctggtgggccgtgaaaaaatgattgccgcgttgcagcgcctgaaaaccagctacgagccgcaagaagcgaccagcatgatggcgttttgtattaacggtaaatcgaaatcgttaagcgagctgtttatgacgcacccaccgctggataaacgcattgaagcgctgcgtagcggcgagtacctgaaataataagcccactggcaagtatgaaaagcgcgtcgaatgacgcgctttttttacgcctgaacgcgtggttgcgtaatacgtaaaccgctcaccaccgccgcgagagtcgccaggatcgccgccgcgagcagcgaaagatgcgtaccgctatcgccaaactggttcaacatcagcgctaccagcgcggcgccagtactttggcctaacagtcgcgccgtgcccagcatcccgctggcgccaccgctgcgctcacgcggcgcggaagtgataatggtgtgattattcggcgactggaacaggccaaaccctgcgccgcaaaggatcatcggccagataatattcagatcggagggggtgcctggcaacatgaccagcgcaaacaacccggctgccattatcaccattcccagcgcccccagcaaaccggcatgaagacgttctatcaggtatcccgccagcggcgccatcaccatcgttgccagcggccagggcgtcaataacaggccggtttctacttcgctacggcccagcacggtttgcagataaaaaggtagcgagaccatggctaacatttgcgcgcagaacgagcaaattgacgtgccgatcgagagtgaaaaaagcggaatgcgtaacaagtcgatgggtaacaaagggacgggcaaagaaagctggcggcgcacgaagaaaaacccgaccacgaccagaacgagcagctctgcgccaatcaacgttagcgactgtccctgggcaaagccgctcaatgcggtaatcagcagaccaaatgtgagcgcattcattaccgcgctcggtaagtcaaagcgcggcttagtgtcatgggcgatgtttgctggtaaaaagcgtatggccagaattaacgcgatgatacctaacgggacattaatcagaaacagccatttctatgatgagatggacaaaatcgccgcggcgatcgtcggacccgcggcggaagagacggcgacgataaaagagttaattcccatacctcgtcccagatgacgctgggggtagataagacgaatcagcgccgtgtttacgctcattagcgccgcgccgccaaattcctgcgcgatgcgcgccagcgtcagcatctgcagcgagtctgaaagcgcgcaaaacaatgatgaaagcagaaataccactaaaccacatttatagatccggtgataaccaaacatgtcgcctaaaaaagacagggaaagtagtgagacgacaatggcgatttggtacgcattgacaatccagatagagctggcaggggaggcatgtaaatcagtcgcaatggttggcagcgcgacattagcgattgcgccatccagaaccgccatcgaaataccgataataatcgtcaggatagcgccgtatctctgcgggaggggcagccgtcggcccgtgttttttccataagtattttgtaataaggggaattatgagctgaataataatgttagcattaatactgagttgttatgtcgtagatttgtaacgaagtaagcaaagatggattgcgggcgacctggcgtgaaattataataaaaactcgttctgaattttataaaacgctcgtaatgaggtgataaatggcaaacgcagatctggataagcagcctgattctgtatcttctgtgctgaaagttttcggcattctgcaggcgctgggtgaagagcgtgaaatagggattaccgagctatcgcagcgcgtcatgatgtcgaaaagcaccgtttatcgctttttgcaaaccatgaaaacgctgggctacgtggctcaggagggggagtctgaaaaatactctctgacgctaaagctgtttgagctgggcgcgcgagctttgcaaaatgttgatctcatccgcagtgcggacattcagatgcgcgaactgtctcgtctgacaaaagaaactatccatcttggcgcgctggatgaagacagcattgtctatatccataaaattgactctatgtacaatctgcggatgtactcacgtattgggcgtcgtaatccgctgtacagtacggccatcggtaaagtgcttctggcctggcgcgaccgtgatgaggttaagcagattctcgacggcgtagagtataagcaaagcacgggacgcacgattaccagcactgaagcgttgctgccgctgttggatgaagtgcgtgcgcaaggctacggtgaagataacgaagaacaggaagaagggttacgttgtatcggcgtaccggtatttgaccgttttggcgtagtcatcgcagggttaagcatttcgttcccgacgctgcgtttttcagaagaacgcctacaggaatatgtggctatgttacacgtcgccgcgcgtaaaatttctgaacaaatgggttacaacgattatcccttctaagcaacgttattagcatgacgttaaaaaaaagcagctacatttttcgtagctgctttttttataacatcgggtgggatgaaatcgtaaaagtagataatatctgtcggcttatttaacggttattaaaatattatttaacagtacttatgaacaacagccaatataggggaattattggtgatagtttcactgtgaaattatttattgccgcttagccattatccaccacggtggcgatttttctgaaaatgggacagtcggaaaagccgataatgccgctgttggtatggagatattgcgccgtgctggtgccgcgtgcggtcaggtaatggcactgtaaacccagccccgcagcgttcactttacttcccaccaggatgccatagccgctcatcagcaggcctatccacaccagggcaaacaatacaattgcgcgaatgatcaaacgcattactacctcttttttagttagaataagagtagcgtgtacattgattgaaacaagtgaatcattcctaaaaacatataatgccgctacagttactcctggtttaagtaacttatgataatttagcgacataagatgtaagatcggagagtggagtgaaaaaatttcgatgggtcgttctcggcatcgtggtggtagtatgcctgttgctgtgggcgcaggtgtttaatatcatgtgcgatcaggatgtacaatttttcagcggtatttgcgccatcaataaatttattccctggtaaacgttttacaccagagatttccttcccgtgtagcagtggtagaatgacgtctctacattgaggtggtgaaatgaacgacgttttaaactctggtgcgttttctcttgcatctttaatagtatcaatggtggttctggtggtggggctggcgctctggttctttgtcaaccgggcaagttcccgtgccaacgagcagatagaactgctcgaagcgttgttggatcaacagaagcggcaaaacgcgttgttacgccgcctttgcgaagcaaacgaaccagaaaaagaagcggaacccgcaacagcggcaagcgaaccgaaagaggatgaggacatcattcgtctggttgctgaacgataatgcttaccggggcgcaaatggcgccagtgccatacgccccatttccccgtcggatctctccgcgttgccgtttgcaactgatactacagcatcaacaccttacctaatatatggctttatatgcaacatagttttatatgtataacaaatggacatatggcatttttgtgataccgctcattctctattaaaagcgaaacgtttctctctctttatggattgtcattgtttgttcattattttaaggcattctgtaaagacgcagaacatcacaaaaagcggtgtcgaaaatcgcttttcttttctattattttgattaaaaggtgttttttatcattgtgacaatttatgcataactcagcataaaaagtgatatgaaaaatacagcttttaaatgtgatttgatgcactggaagaagcgaaattattgagctatggtagaaaaatggcttttcagcagtgacgttgtcaggagtccgtcagcgcgtgaggatatatctttcgcaattttgttgcataaacgtgttgtcaatttgtgaaggttctcgtaatttgtgcgacggatcgagacacgtttaaaaatggcttgccataattaacgttatatgtgataacaggctttgggttaaacgaggtacagttctgtttatgtgtggcattttcagtaaagaagtcctgagtaaacacgttgacgttgaataccgcttctctgccgaaccttatattagtgcctcaagcagtaatgtctcagttttatctatgttatgcctacgggcaaagaaaacactctaaggaattttgcaaatggcaaagattaaaggtcaagttaagtggttcaacgaatccaaaggttttggcttcattactccggctgacggcagcaaagatgtgttcgtacacttctccgctatccagggcaatggtttcaaaactctggctgaaggccagaacgttgagttcgaaattcaggacggccagaaaggtccggctgctgttaacgtaacagctatctgatcgacaccactgatttgatgcgtttgtcgcgtcagcctcagatataaagcctcgctaaaagcggggctttttaattcaatatccttcaaaatgtgtctggatgcgctctcgttagcgatttgttgcaaaggcgcgatgttattagcattgttttttctggtttttccggccgtttcccgttaaatcaatcacctgaaaaatgattcggctggagatcaggtgaaaaagaaaagcgacggcgatacccgtaattttacacccatacgttttgcactactttgcactgccattctgctcagtatggcattgttgttagggcgggtggcatggctgcaaattgttacgccgtcgaaactggtgaaacaagaagatatgcgctcgcttcgtgaagtgaccacggcctctccacgcggcatgatcaccgacagagaagggcggcccttagcggtgagcgttccggttaatgctgtctgggccgatccgaaaactatcataagcaaaggcggcgttggctacaatgagcgctggcaggcgctggccagcgccttacatctgtctctcagtacgcttgcggaacgggtaaacagtaacccggcaggtcgttttatctacctcgcgcgccaggtttcaccccagcaagccgaatggatagataaactgaatctaccgggtattaacctgcgggaagagtcgcgccgtttttaccctgccggacatgtagcggccaatttgatcggctttaccaatatcgacgggcagggaatagaaggtattgaaaagagctttaacgcgcaactgacgggaaaaccgggctcccggctggtgcgtaaagataaatttggtcacgttattgagaacattacggaagtgaatccggttcctgctcatgaacttcagcttagcattgatgaacgtctgcaaacggttaccgaagatgcgctggataacgccgtcatctggaacaaagcggaatccggcgctgccgtattgattaacatcccaacgggtgaaattctctcgatggcgagctacccggatttcaacccgaacaaccgtgaaggcgcgcagttggacgattttcgtaaccgcgcgattagcgacactttcgaacccggttctactgtgaagccattggtcattatgactgcgttacagcagggtatcgtgcaaccggacagcgttatcgatacccatccttttactctcgatggacaccgtatccgcgacgtcggctactatccggaactgacattaaccggcattttgcaaaaatccagcgataccggcgtttctcacctttctctggcgatgccggtgcagaaattaatggatacttataaaagctttggtttcggcgtgcctaccggactgggtctcaccggagagagcagcgggttattaccgaaacgccgttactggagtgatttagatcgcgctaccttcgcttttggctatggattaatggtgacgccgctgcaactggcgcatgtttatgccacgattggcagctttggtatctaccgtccgttatcgatcaccaaagttgatccgcccgtgatcggcacgcgagtaatgccggaagaactggtgcacgaggtggaacatatgatggagagcgtcgcgttgcctggcggcggcggaacaaaagccgcagtaagagactaccgtattgcggtcaaaaccgggacggcgaaaaaaattggcgatgatggtaaatacgttgataagtatgtggcatataccgcaggcgtcgcgccggcaagtaaccccagatttgcgctggtggtggtgattaataatccacaaaatggggcttattatggcggtgcggtatctgcgcccgtattcagccagatcatgggcgatgtactgcggctggaaaatgttgagccagacggtatgccagccgattcagatcaccttctggtgatgcatggcagccacgttgcggttccgggctcgtaaaggattttcccggggcgcaattcgcgttacacttgcgccctttagcgccccagtccggagttgtcatgtcgtttacctgtccgctttgccatcaaccgcttacgcagattaatagcagcgttatatgtccacagcgccatcagtttgatgtggcgaaagagggctacatcaatctgctgccggtacagcataaacgttcgcgcgatccgggcgacagcgccgaaatgatgcaggcgaggagagcgtttcttgatgcaggccattatcagccgctgcgcgatgcggtgattaacctgttgcgcgagcggctggatcagtcggccacggcgattctggatattggctgcggcgaggggtattacactcatgcttttgccgaggcgttgccgggagttaccacgtttggactggacgttgctaaaacggcgatcaaagcggcggcgaagcgctattcgcaggtgaagttttgtgtggcgtcaagccatcgactgccctttgccgatgcgtcaatggatgcggtgatcagaatctacgctccgtgtaaggcgcaggaattggcgcgtgtggtgaaacctggtggttgggtcgttaccgccacgccggggccgcatcatctgatggaactaaaagggctcatttatgatgaggtgcgtttacatgcgccgtataccgagcagctcgacggattcacattgcagcagagtacccgccttgcttatcacatgcagctcaccgccgaagcggctgtagcactgttgcaaatgacgccatttgcctggcgcgccagaccagacgtgtgggaacaactggctgccagcgccggacttagctgccagacggatttcaaccttcatctctggcagcgtaaccgttaaccgtgaaaatgcgtccagaggatctggacgccaattcctatcagtacgaccccgccgagaatttcagcacgcttacccagcattgggccgataaagcgaccgatcatcattccgagggtggacatgataagcgtggcgcaaccgatagctaatgcggttgcgatgatgtttacctgcaaaaacgccagaccgacgccaaccgccatcgcatcgaggctggtcgcgatagccgtcgtgactaatagccaaaagctgtgacgacgtaacggtgtttcatcttcatcactaccgccgcggataccttcgatgatcatgcgtccgcccagaaagatcagcagaacaaaggctatccagtggttccattccagaacgaatttactcgccaatatccccagcccccagccgatcaacggggttagcgtttcaaccgcgccaaagataagaccggtacgcaacgcttctgagaatttgggtttatgtagggtggcgcctttgccaattgatgccgcgaaagcatccatcgacatgccgaaagcgagaagaacagtagcagtaaagtgcatgacagcgtcctgaccggggtatccattaaacacatcactgcccccagcaaacatgcatgtcgccattctgtgacgaaatacacagcagttgatgcgcctatggtctcgcctgaccagcggcggctggtccgtacgcgccacgttttgcaacgagtatgttgacacgtacatttccggagtctggaaatcggctactccctaattgacggcgcaacattaacatatttttagaatataaaacaacagcgataaaatattatttgccttctaattgaaaacgattttcatttagatttattcatcaataaaacgttaaattaaataacaattggtcaatagaaaatatagccttagctatattatgattcgaaataaaattcgaaaaacatagttgaggctatatcttaagctattgattttcaataagaagtttatatattttttccagatcgtcgatattgcgtacacggataagcaagcgtcgttgttctaattgcatcaccagtacgccgtcctccgataaattcatctctttaatacggttatattctatccagacattggcgaagaaaaagccacgttgtttaaagatgatccgtggcgtgcggatccagaatatataaaaccccattaacgccagcgcgcttaataaccatgtggtcatctgcgctccgtggctggttacgttgttataaataaggatggcgaccagcccaacgaagataacgctgtctatgcgaccgcggcggagcagggctatagaaagcagagtggggccattgcgacggggcatgatgaactgatcgtagagagcgtaagccaataatgcggcaataaagagaatcagcaccaggtccgtgatagtcatttatcctccagagaaataaaaaaacggggccgtttggccccggtagtgtacaacagccttactggcccagcagtcctacggagtagccggcgataccaatgacgaagaagcccacgataatccacagcgggttaactttcttacgcagcagccacatacaggcaaaggtcaacagtagcggaaccagacccggcatcagctggtcgagaatggtttgcacggtggtaacgcgtgtctgaccatcctgaccggtgatggtggagaccaccagcgggatattcacatgcgtccacttgttaaccaatgcccccatgacaaacaggccgaggattgacgccccctcagtcagtttttgcaggaagccgccgcccatatctttaacgatatcgacgcctttgcggtagccataagccacgccataataacgggtcgccagacgcaccaggttaaacaggatgaaaaacagcagcggaccaagcaggctgccgctcattgcaatacctgcgcccagcgccgcgaatactggacggacggtaccccagaagatagggtcgccgacgcctgccagcggtcccatcagaccgactttgataccgttgatagcaccatcgtcaatctctgcgccgttcgcacgcttttcttccattgccagcgttacgcccagtaccggcgccgcaacgtaaggatgagtgttaaagaactccaggtgacgcttaatcgcctgtttacgcgcgtcattattctccggatacaggcgacgaatcgccggcaccatagagaagcagaagcccagcgcttgcatacgttcgaagttccatgacccctggaacaggttagaacgaagaaatacgccgcgaatatcgctcggagtgagttttttctcggtggtagttttagtcatatcaaccatttcgctcacctgttagtccagttcgttatcgagatcgttattgccagcagccgctgcaggcgcgcccgctacacggttgtatttcgggctcagctggatgtaaagaatagccatcactgcgccgatgacacccagtgcgaccaggttgaagtttgtgaaagccgcggtgacgaaaccgaggtagaagaacggcatcaggtagcctgcgcgcatcatgttgataaccatcgcataaccaaccacgacgatcatgccgccggcgatgttcagaccgcctgtgacgacttcaggaatcgcattcagcattccctgtacttcgctggtgcctacggagatggcaacgataaccgccgggatggcgatacgcattgcctgcaggaacagagaagaaacgtgcagccaggagagcgccgtcaggttgccgttttcagccgccttgtccgccgcgtgctggaatgccacggtgatggtacgaacgataatggtcagtacctggcctgccgccgccagcggaatcgccagcgcgataccggcgccaatgctttgatgcccagcgatgaccagaacggtagagatgatggacgccagtgcggcatcaggcgcaacggcagcaccgatgttcatccagcccagagcgatcatttccagagtaccgccgatgataataccggttttcatgtcccccagaacggcgccgattaaggtacaggcgatcagcggacggtggaactgaaattcatcaagtaccgactccatacccgcgatacatgcgacgatgaacaccagcacaatctgaagagtggtaatctccattgtacttctcctattgctatcttaagtgtgaaagctaattaaatgccggcggttatttcgccactttggcaattaaatccatcattttcagtttcggatcggtggaaactttacgcacctcaagctcgatgccgcgctcgttgagctttttaaaggcttcgatatccttttcatcgacggaaacggcgttgttcacctgcgttttaccttgacgataggccataccgccaatgttcacggaggtgactttcacgccgccctcaacgatgcgctcgacgtcggtaggattggtaaacagaagcatcacgcgttcgccggcgtatttcgggttattgtagacgcgaatcatcttcgcgacgtcaaccacatgcgccgtaacgcccggcggcgcaacttgcgtcagcagcgttttacgtacggtatccgccgcgacttcatcgctcacaacaataatacggctgacattggtctctttggtccagcgggtagcgacctgaccgtgaatgaggcggtcatcaatacgggcaagcccgataaccatataatcattcgggcccatcggttttgccggcgtggccgcttttggcgcggcggcgaccggcgctggcgcggctttttctaccggtttcgctttcagcgcttttacgccttcacgaccggtttctaccgccagtgcgaccagctcgtcaaagctcggatcgtcgtcacgagccataaacgtttcgaccagcatcgggatgttgacgccggcaataacttcatagcgctctttatcgacgacaatgcggctggcagcattaaacggactgcctccccatgtatcaacgagaaatagcacgcctttactggtatcgagtttagccaactgagcgttgtacttttcgatcagcgtttcggcattttcgcctggaacgaaatcgatccagccgacgttttcctgctcgcctaacagcatttcggctgttttaagtaactgctctgcagcccaaccatgtgtgcctataacaatagcaatggtcacttgctacctcctttattattgtcaacacatcaacttgacagatgtattttttgaatcgccgtccgcaagcgaatcgattcagatgagggttacaacgaaaaacgcatgattttcgtgaattattttagatatcgaaaaaaatattttgtgtgatggagatctgtaattttgttttcgataatgagaaatttcgaagtgtaaaatatcctggttacatctctttgcaaaggaaggtaaatctttgccaaaaaccagttgtctctgttatgtttagcttccgtttaattagaatggggtatagggcagcagcccgttgtatggatcgtcaccgacgtcatttcactctttggccgttttgcgcctgtcaatctggcatatcttgccatagccttactttgtttattgcgttaccgcctgcatcctttgagatgttgtgggcgccgtttagtcattccttaagcaggagcttgtcatggaattattaatggatccctcaatttgggtgggtttactcacgctcgtcgtcctggaaattgtcctaggtatcgataacctggtctttatcgcgatcctcgccgataaattgccgccaaagcagcgtgacaaagcgcgtcttatcgggctctcgctggcgctgattatgcgtctggcgctgctgtccattatttcgtggctggtgaccttaacaaagtcgctctttactgtctgggattttaccttctccggccgcgatttaattatgctgctgggcggtatattcctgctgtttaaagcgaccaccgagctgcatgaacgtctggaaaaccgcgagcatgacaccggacacggtaaaggctatgcgagcttctgggtggtagtcacgcagattgtcatcctggatgcggtcttctcgctggacgccgtgattacggcggtaggtatggtaaaccatctgccggttatgatggcggcggtggtgattgcgatggcggtgatgctactggcgtcaaaaccgctgacccgttttgtcaaccagcatccgacggtggtggtgctctgtctgagtttcctgctgatgatcggcttgagcctggtggcggaaggatttggtttccatattccgaaaggctacctgtacgcggcaattggtttctcgatcgttatcgaggtgtttaaccagattgcgcgccgcaactttattcgtcatcagtccacgttgccgctgcgcgcgcgtactgcggacgctatcctgcgtctgatgggcggtaaacgtcaggcgagtatgcaacatgagacggatagcccggccgcgatatcggtgtcggaaggcgccttcgccgaagaagaacgctacatgattaacggcgtactgactctggcgtcgcgctccctgcgcggcattatgacgccgcgaggcgaaattagttgggtggatgcgaatctcagcgtagctgaaatccgtcagcagttactctcttctccgcatagcctgttcccggtatgtcggggcgagctggatgaaattatcggtatcgttcgggcgaaagagttgctggtggcgctggaagagggcgcggacgttgcggctatcgccgcctcttccccggcgatagtggtgccggaaacgcttgatcctatcaatctgttaggcgttttgcgtcgcgcgcgcggcagtttcgttatcgtcactaacgagttcggcgtggtgcaggggctggttacgccgctggatgtgctggaagcgattgccggtgagttcccggatgccgatgaaacgccggaaatcgttgccgatgccgagggctggatagtgaagggcggcaccgatcttcatgcgttacagcaggcgctggaagttgaccatctggtgaacgaagagggtgatattgcgacggtcgcggggttagtgatcgccgctaatggccatattcctcgtgtaggcgatgtcattgatgttccgcccctgcggatcaccattgtcgaggccaacgactaccgtgtcgatctggttcgaattgttaaagaacagcctgcccacgacgaagaggaataacgtcacacgcaggaatcaagtctatagatgcggcatcgcggacataatctgtccgttatgccgggcgggcggcggcgcgctgcccgccagccactgtggaaattcgctaatgggcatcggcttcgcatagagatagccctgtaacatttgcacgccatgctggcgcaaatgctgtgcctgcgtctggttttcgaccccttccgcaaccagttcaatattcagtctttgccccagcgcgataataatatcggtcaccgttgaattgaccgcatcggtaccgatgacggcggtgaagaatttatcgattttcaaaatatccggacgcagtttttccagccaggagagcgagctgtttcctgtgccaaaatcatcgatggctaacttcacgcctttacgatgcagctcgcgcatcaggcggtaatcaacgtcaagcaacgcgtcgcgttccgtgagctccagcaccagttgctgaacaggttccgcactaaaccagtactgattaagatccttgagaagcacgccgtgtcggaaatggcttgccgccacattgatgccgatatgaaactgatggttgatggggaagtagtgccgctgccgaatggtttccgcaatcacatagcgggtcagcggcgctatcaggttatgctcctcggtgataggaataaaaacatccggtgagatccagccctggcgcgggttattccagcgtaacaggatctcaacgccggtacactgctgcgtgcgggcattaagcaacggctgacaaaatagctcaaactcccgttcggcaagggccagattaatttcccaggaaaagctcattctgctggcggttgccagccaggcgatataaccgatcaacaggctaagcaatacggccagcggtaactgcgtcgggagatgtttgaacgccagtacgcctgccgacggcccgctgacgctgatagtaaaagggaaatgccgcgatgaaagctggtaacgctcttcatctttttttaattccggaagagtatcgaccacgccccgaccatataacaggtgccgtttgccgaccgtcaggctggcgctggtaatttgcggctgctgcggctcaagtagcatagtcgccagcaagtcaatattcacaatttccatcacgccatcctgtccatcggcagaggcgggataccactgaatgaggatcgggcttcccttgagtaacgattggtccgtggaaagtagcagcagatcgccagctgcgggaagatcgggctgaagctggcgtatgggagtattacgggcgccaaaaatgcttgagcagtagagaattccctcttttaccagcccgatagaacgaatggtttgcaggcgggcggcttgcttacgcaacggcagatgcgcggtcgcgcacggaagctcaagtaagggtagcagtatgtttcgtccgaccaggagaggatgcagcacattatccagcgcatcaacggcatgattcgcgaatgcaaccgtgcgatggtgatttaagttccgctccgaaataaatcggatgttcagcgtaagaatgagcgtgaccagtgcacaaatcgtgcaaacaatgaaacgattacggcgataatgattgatgatccgttgtgctgtttgcatgcgggccgcccaataagcgttggcgacaaaagccaaccgcgacacagcaagtgtagtggggaaacgtggagtcgacgaggaagagataaaaatttcgcccatccgtagcagatgggcgaagggaggggaaatggcgtttaatcacactggactttaatagccaacccgccgcgcgacgtttcgcggtatttggcgttcatgtcttttccggtctcgtacatcgtttcgatgactttatccagcgagacgcgcggcgcgctggttcgacgcatggccatacgcgcagcgttgatcgctttaaccgaagcaatggcgttacgctcgatacacggcacctgcacctgaccggcaaccgggtcgcaggtcagccccaggttatgctccatgccgatttcagcggcaacgcaaacctgttccgggctggcgcccaacagttcagcaaggcctgccgccgccatcgaacaggcgaccccgacttcgccctgacagccgacttccgcgccggaaatagacgcgttcatcttatacagcgcgccaatagcgcctgccgccaggaagtagcgggtgtaaatatccgggctgacagactcaataaaatggtcgtagtaagccagtaccgcaggaacgatgccgcacgcgccgttggttggcgccgtcacgacgcgaccgcctgcggcattctcttcgttcaccgccagagcaaacatgttcacccagtcaatgacgttcatcggatcgctggaaagcttatcgctggaaaccagcatacgacgcagcgcagaggcgcgacgcggtacgcgcagcggccccggcagaacgccttcggtattcataccgcgatcaatacaagcctgcatggtttgccagacgtgaccgaaatactcttcaatctctttcttgctatgcagcgccagttcgttttgcatcaccatgccggagagtgaaaggccggtgctgttgcaatactccagcatttctttcgccgatttaaacggataaggtacagtaacctcattcgtcgcttcctggccgaaatgcgcttcatcaacgataaagccgccgccgatggaatagtacgtcttgctataaatgaccgtgtcgtcatgccaggcgtggatctgcatcccgttttcatgcagcggcaaattgccgttgtgaaaacgcattccgtcatctttcgggaagtcgacttcgtgacgtccctgggccagtaacagacgctcgcgcgtttcgacgtcgcgaataaaaccggggatactatcaatatccacggtagcgggttcattacccgccagacccataataatggcgatatcggtatggtgacctttccccgtcagcgacagcgagccgtagacatcgacagcgacgcgggtaacgttatccagtaatcctttttcgactaggtcatcgacgaactgtttaccggccttcatcgggccaacagtgtgggaagaggagggaccaatccctaccttaaacatgtcgaataggctaatcacgataatactcctgacagggcaaccggggcttccggttacgatgttataactgcgcatagtgtaagagggaacgctggcatcagcttaactattcacatgaattaaactaatgaataaccgcgtttttactaatattgcgacagtaatctcaagtcgtgtcttgcgcgcgtaaagttaagtatatacacgttgcccttcaggctgcctctttgggggaggcgattgttaccgccttgaggcaacgtgaatggcgttgtgtacagtcagggctttacgccgatttgcagcgccagctcacgaagaatgtttgcggtcatgccccagacgaaataatgctcataccaggagagccatacgcggtgcgaattgccgcgacggtaaacatcaagcggatgatatcgacccagttgcaacgcttgcgccagcggcatttcaaacaccgcagacacttcgtcttcactggcgcgccaggggagatttggcggaataatgccgaccaccgaggtgacctgaaaaccggtcacgctgtctaccggcggtaaaacgccaatcacttccacggcttgcggcgggatggcgacttcctcctgcgcttcgcgaagcgctgcggcgataagcgaagcatcggtactgtccacggccccgccgggaaaggcgacctgtccggcgtgtttgcgcaaatgaatagcccgctgggtcaacagcagccccggctgggggcggcgaaccacagggatcagtacggcggcctgacgttgatttaacgtttcatgagtcatctgcgggcgcaaaagctgaaagcgcgataagaaatgatcgagcgtcagacggctggtatccacgtattagttctccagtgggtgcaggatacgattaactttatcaaaagtttcctgatattccgcttcttcgttgctatcggccacgataccgccgccggctgagcaatagagttggccctgcgttgccgtgacggtgcggatagtaatactggtatccatcttgccgcagaaactcagataaccgatgctaccgcaccaggcgttgcgtcgctgcggctccagttcgtcgataatttccattgcccgcactttaggcgcgccggtaatggagccgccggggaaagccgcgcgcagcagatcggtggcatgaagcgagtctggtaaacgggcagtaatggtgctaaccagatggtgaacggcaggaaatggttcgacgacgaacagttccggcactttcaccgaacctggtacggcgacccggccaatgtcgttacgcatcaaatcgacaatcatcaaattttcagcgcgatctttcattgaattagccagtttctgcgcctgctgacgatccgcctgcggatcgttaagccgtggaagcgtacctttgatcgggcgcgtctgaatatgaccgttctccagttggataaaacgctcgggagaaaggctcaatatggcgccgtcatgtaaacgaagaaaggcgctgaacggggcgcgatttgcgcggttaaggcgttcgaaagcctgccattcatcaccctcgtagctcgcctgaaaacgctgggaaagattgacctgatagcagtccccgctgtgcagccaggcctgcacctgacgaaacttctcgccatactcgcaacgcgtcatattggattgccaggccgaggtaagcctgaagggcgttcgggtcggcgcgcgctggccggtgagccagcgatatcgggcgtctgcatcgtgatagcttatcagcgacactacctgtttatggtgatcgacaatcagcgcccagtcgtaaaggccaatcgccatatcgggtaaagcgatatcgcgcgcggcagtatcgggcagaatttcgaaacgccgccctaaatcataaccaaacagacccagcgcgccgccctgaaagggtaagtcagggtcaggctgaggatgaaaaggcagcgcctccagttgagtctgcaaaacgtgtaacggatcgtcgagagtgacggtagtcgtgcgcgcagtacataccgtggtttcctgggcgcgcgtggtcagtgtggtgacaggatcggcgaccagaatatcaaaacggttatagggatgaatagcatcacctgaatgcagcagcatcgcccagggcaaatggtttacgggcgcaaaatagtgttcagcggcgtccggacgccagggtaaggtgataacagtgggagataacgtcttcatcattcctgactcgttacaacactactggcttaccgccgggtagcgtgaaataattagcgctaacaatttagcaggagttaatcatgtttgcaggtttaccttcactcagtcatgaacaacagcaaaaagccgtagaacgtatccaggaattgatgtcgcaaggtatgagtagcggagaagcgattgcccaggtggcaggcgaacttcgcgccaaccataccggcgaacggatagtggcgcgttttgaggatgaagacgaataaccggcttataccgccgcgacaatcttaatctcaactttatatttcgggttcatcaacccggcctgtacggtacagcgtaccggcgcatggcctgcgacgacccacgcatcccacgccttattcatggcggcaaaatccgctttatcgctcaggaaaatagtggcatccagaatacgtgacttactggagccctgtttttccagcaccgcatcaatttgcgccagagtattcgccgtttgctcaaaagcatcggcgtccaggttttccggcacgccgatataccacagcgtattattgtagatcaccacgtctgaccaacgatcttcggcatcaatacgcacgatagacatcacttattcctcatttgctttccatttgaatggctcaagactgccacaatgtggcgccgccgtcacctctgtaactggcgtaagcctttctaccctgacataatcccctgtgcaaattaacagggggcagtgtgacggacgattttgcagcagatggccaactggccaaagcgataaccggctttaaaccgcgcgaaccacagcgacaaatggcggttgccgtgacacaagcgattgaaaatgcgcagcctttggttgttgaagccggcaccggaaccgggaagacctatgcttacctcgctccggcgttgcgcgccgggaaaaaagtcattatttcgaccgggtcgaaagcgttgcaggatcaactctacagccgcgatctgccgacggtagcaaaagcgttggcgtttaccggtaagacggccctgttgaaaggacgttcaaactacctctgcctggagcgtctggaacaacaagcgctggcgggcggcgatttaccggtacaaacgttaagcgacgtgatattgctgcgctcctggtcaaatcagacgcgggatggcgatatcagcacctgcgtcagcgtggcggaggattcccaggcctggccgctggtcaccagtaccaacgacaactgccttggcagcgattgtccgctttacaaagagtgctttgtggtgaaagcgcgtaaaaaggcgatggacgcggatgtggtgattgtaaaccaccacctttttcttgcggatatggtggttaaagagagcgggtttggcgaacttatccctcaggctgaagtaatgatcttcgatgaagcccaccaactgcctgacatcgccagccagtatttcggacaatcgctctctagccgtcagttgctggatttagcaaaagacatcaccatcgcctaccggacggaactgaaagacactcaacagttgcaaaaatgcgccgatcgccttgcccagagcgcccaggattttcgtctgcaactgggggagcccggctaccggggaaatttgcgtgaactgttagccgactctcgtatccaacgggcatttttactgctggatgatacgctggagctttgttacgacgtggcgaaactgtcgctgggccgttcggcgctgctggatgcggcttttgaacgcgccacgctataccgttcacggctgaaacgcttaaaagagatcaatcagccgggatacagctactggtatgagtgcacctcgcgccatttcactctggcgctgacgccgctcaccgtggcggacaaattcaaagaggtgatggaacagaagcccggtagctggatttttacctcggccacgttgtcggtaaatgatgatctccaccactttaccgcccgtctgggaattgaacaggcagaatccatgctgttgcccagcccattcgactatacgcgccaggcgttactctgcgtaccgcgtaacctaccgcaaaccaaccagcccggcgcggcgcgacagttggcggctatgctcaggccgattatcgaagccaataacgggcgatgttttatgctgtgcacctcacacgccatgatgcgcgatctggcggagcagtttcgcgccaccatgacgctgccggtattgttgcaaggggaaaccagtaaaggccaactgttacagcaatttgttagcgccggcaacgcgctgctcgtcgccaccagcagcttctgggaaggggtggacgtgcgcggcgatacgttatctttggtgattatcgacaaattgccgtttacttccccggacgacccgctgttaaaagcgcgaatggaagactgtcgtttgcgcggtggcgatccgtttgatgaggttcaactgcccgatgcggtgattacgctgaagcagggagtggggcggctaattcgcgatgcggacgatcgcggggtgttagtgatttgtgataaccggctggtgatgcggccctatggcgccacgtttctcgccagcctgcctcctgcgccgcgcacgcgtgatatcgcccgtgccgttcgctttcttgcgattccatccgccgagtaatttgttacggagtatggtaagatgcgcgctattttattgatctaagcacgaaacctcatgcgaattctggctatcgataccgccacagaggcctgttctgtcgccctgtggaacaacggtactatcaatgctcactttgagctttgtccacgagaacacactcaacgtatcctgcccatggtgcaggagattctggccgccagcggcgcctcgctcaatgagatagatgcgctggcgtttgggcgcggtccgggcagctttaccggcgtgcgtatcggcattgggattgcgcaagggctggcgttaggggcaaatctgccgatgatcggtgtttcgacgcttgccacgatggcgcagggcgcatggcgtaaaactggcgcgacccgcgtactcgccgcgattgacgcgcggatgggcgaagtgtactgggcggaataccagcgtgatgcgcagggcgtctggcagggcgaagagacggaagcggtgctgaaaccggaacgggtcggcgagcggttgaaacagctttccggcgagtgggcgaccgtaggaacgggttggtccgcatggcccgatctggcgaaggagtgcggcctgacgcttcatgatggggaggtgtcgctcccggcagcggaagatatgttgcccatcgccagtcaaaagctggcggcaggagagaccgttgccgtggaacatgccgagccggtttatttgcgtaacgaagtggcgtggaagaaacttcccggcaaagaatgactctcactactattacccccatactttatgctgtggggtggaatagaggtcgagaaaaaggagtcgcatcatggcggttcaaaaacggttaataaaaggggcgctggcgtgcgcttttgcgcttatgctgagcggttgcgtgactatcccggatgccattaaaggttcgagtccgacgccgcagcaggatttggtgcgggtgatgaatgcgccgcagctctatatcgggcaagaggcgcgttttggcggcaaagttgtggcggtacaaaatcagcagggaaaaacccggcttgaaatcgcgaccgtaccgctcgacagcggcgcgcgtcctgttctgggcgaagcctcgcgcggcagaatttttgccgatgtgaacggttttctggacccggtggacttccgtggccagttagttaccgttgtcggcccgataaccggcacggttgacggtaaaatcggcaatacgccgtataaatttatgctgatgcaggctaccggctataaacgctggcatcttgttcagcaggtcgtcatgcctccacagccgatcgatccgtggttttacggcggacgcgcctggccttatggatatggcggttggggatggtataaccctggacccgcagaggttcagacgatagtaacagagtaaccctttgttttatcaataaaagaaacagcggctggtccgctgtttctgcattcatagagacataataaaaataaatagtgacgcgcttcgcaacctttcagttgcgtaattaataaactggtacgctgagttaatataatgttaacgacttgtttattgactggggttgtgatgacgacgaacactcattttagaggtgatgcattgaagaaggtttggcttaaccgttatcctgctgatgttccggcggagatcaaccctgaccgttatcaatccctggttgaactgtttgaacatgcggcgacgcgctatgccgatcagcctgcgttcgtcaatatgggggaggtaatgaccttccgtaaattagaagaacgtagtcgggcatttgcggcttatttacaacaagggctgggactcaaaaaaggcgaccgtgtggcgctgatgatgccaaacctgttgcagtatcctgtcgcgctatttggtattttacgcgccggcatgattgtggtgaacgttaacccgctttacacgccgcgcgaacttgagcatcagcttaacgatagcggcgcggcggcaatcattattgtttctaactttgcccatacgctggaaaaagtggtcgagaaaacgtcggtacagcacgttattctgacgcggatgggcgaccagctttctaccgccaaaggtacggttgttaactttgtcgtgaaatacatcaagcgtctggtgccaaaataccacttgccagatgcgatctcgtttcgcagcgcgctacagcatggctaccgtatgcagtatgtcaaacccgaggttgtcgctgaagatctggctttcctgcaatatactggcggtacgacgggcgtggcgaaaggcgcgatgttgacccaccgcaatatgctggcgaatctggagcaggtgaaagcgacctatgggccgctgctgcacccggggaaagagctggtagtgaccgcgctgccgctgtatcacatttttgccttaaccatgaactgtctgctttttatcgagctgggtgggcaaaacctgctgattaccaatccgcgtgatatccccggtctggtcaaggagctggcgaaatatccatttacggcgatgactggcgttaatacgctattcaacgccctgctcaataataaagagtttcaacagctggatttttcttcgctgcatctgtcagccggcggcgggatgccggtgcaaaacgtcgttgcggaacgttgggtaaagctgaccgggcaatacctgctggaaggctacgggctgaccgagtgcgccccgctggtgagcgtcaacccgcatgatattgattatcacagcggcagtatcggcctgccagtaccgtcaacagaagccaaactggtggatgacgatgacaacgaagtcgcgccgggtgaggccggagagctttgcgtgaaaggcccgcaggttatgctgggatactggcagcgtcctgacgcgacggatgaaatcattaaagatggctggctgcatacgggcgatattgcggttatggatgaagacggctttctgcggattgtcgatcgtaagaaagatatgattctggtttctggtttcaacgtttatccaaacgaaattgaagatgtggtgatgcagcattctggcgtgcaggaagtcgcggcggttggcgtgccttccggtagtagcggcgaagcggtgaagctttttgtggttaagaaagatccggcattgactgacgatgcgttgatcaccttctgccgtcgccatctgaccggatataaggtgcccaaacaggtcgagtttcgcgaggaattaccaaaatctaacgttgggaaaattttacgacgagaactgcgtgacgaagcccgtggcaaagtagacaataaagcctgagcgttaagtcagctaacgagagacgccggttaagccggcgttttttttggcgcgaaccaaagagaacacgatttgaattaccaaatgattgaaacggacgatgcgctggcgagcctgtgtgaggctgtccgcgcatgtccggctattgctttagatacggaatttgtccgtacccgcacctattacccgcagttaggattgatccagttatttgacggggcaaatgtcgccctgatcgatccgctcggcatcagcgactggtcgccgttaaaagcggtgttgcgcgatacgggaatcaccaaatttctgcacgcgggtagcgaagatctggaagtatttctgaatgcgtttggcgaactgccggaacctctgattgatacgcaaattctggcggcgttttgcgggcgtccgctgtcgtggggttttgcgtcgatggtagaagagtatacgggcgtggcgctggacaaaagcgagtctcgtaccgactggttagcccggcctttaagcgaacgtcagtgtgaatacgcggcggcggatgtctggtatctgttaccgatcgccaaaaagctgatgattgaaactgaagccgcaggatggctgcctgccgcgcttgatgaatgccgattgatgcagcagcgtcgtcaggagattcaggcgccggaagaagcatggcgggatatcaccaatgcctggcaactgcgtactcgccagttagcctgtctgcaacttttagctgactggcggctacgtaaggcgcgtgagcgcgatatggcggtgaactttgttgtgcgtgaagaaaacctgtgggcggtcgcgcgttatatgccgggcagtctcggtgagctggatagcctggggctttccggcagcgagattcgttttcacggcaagacgttgatatcgctggtggcgaaagcacaggcgctaccggaagaggcattgccggaacccctgttgaatctgatggacatgccgggctatcgcaaagcgtttaaggccatcaaagcgctagtggcggaggtgagcgcgtcgcatcacgtcagcggcgagctactggcatcgcgtcggcagattaatcagttgcttaactggcactggaaattaaaaccgcaaaatgggcaaccggaattgatttccggctggcgcgccgaactgatggcggagaagttaactcttctgttgcaggagtattcgctttaacgacggtaattgccgggaaaacggccagtgaaataaatgtccgtattcggaataatgtaaaaaaataaaaaaggcagattcttctgccttttttaatccaggaattttcccataaaagagcttattttgactcttcggcttccggcagcgttacgttaagttcaaggatggagatatcaccatctttttgctcaagctggacggtaaccatttccggatcgatttgtacgtatttacaaatgacctcaagaatatctttacgtaactgcggtaaataatgcggttcggcatcgctacggcgacgttccgcgacaatgatttgcaaccgctcttttgcaatattagcggtactctttttccgcgagagaaaaaaatccagtaatgccataatttatcctccgaacaggcgtttgaggaaacctttcttctcttcttcaatgaagcggaaaggacgttcttctcccaacagacgatctacggtatctgcataggctttacccgcatccgcagtggcgtcaagaatcaccggttcgccctggttcgatgcgcgcagtacggattgatcttccgggatcacaccgacgagtttaatacgcagaatctccagtacatcttccatgctgagcatgtcgcctttattgacgcggcctggattgtagcgcgtcaacaggagatattctttaatcggttcttcgccattttctgcgcgacgagatttcgatgccagaatacccagaatacggtccgagtcacggacagaagagacttccgggttggtcgtgatgatcgcttcatcggcaaaatagagcgccatcagcgccccggtttcgatacccgccggcgagtcgcaaacaatgaactcaaagtccattgctttcagtgagtccagtaccttagcgacgccttcgcgcgttagcgcgtctttatcccgggtctgcgacgccggaagaatgaagagattttcagtacgcttatctttgatcagcgcctgattcagtgtcgcatcgccctgaatgacgtttacaaaatcgtaaacgacacgacgttcgcaccccataatcagatcgaggttacgcagtccgatatcaaaatcaatgacgacagttttctttcccttctgggccaaacctgtagcgatggccgcgctggaggtggtcttgccaacgccccctttacccgaagtaacaacaataatgcgtgccataaaaattccttgttaaaaagggatcaattcaacggttgaactgtcaaagcgttgtctgctaaacgcaggcgcgccgctttgccataaaattctgccgggattttatcactcagccagtaaacacctgcgatagagaccagttctgccgtcagatgggtacaaaaaatttgcgcttcccgatcgccgctcgcccctgccagcgcgcgacctctcatcatgccatagacatggatattgccgtcagcgataagctctgcgccagcgctgacgtgacttgtaacaatcagatcacattgtggagcataaatgcgctgaccggaacgaaccggaacatcaattaatcgcgtttttgtgatgggattagcgttttgcggcggttcgctgggcgttgccggctcaacgggcgcaggccgaaccgctttctctttaccttcagtcagtaaaggaagacccatccgatcgatttctactttcaggctggcgtctttacagccgctcacgccgataatgcgtaagccggttgaggtcacgatcttatgcagttccggccagtttaccgggctttcaagaccgctaacgttaataacgacaggggcgtgttttaaaaacgcaggagcctgcgctattttgtcttctaacgcctgacgaataacctctggttccgcttcatgcaaatgaaccactgataaggtgaagctactgcctttaagctcgattggcgtgtttgacatcctggccttactcaatttgctatttatcatctccgatacggagtgatattccgaagtccagaaggcatgttatagtcagtattatattgaggcaagtcaccatcccgttaattcagagtaaaagtatgttttgtgtgatctatagaagtagcaagcgcgatcaaacctatttgtatgtcgaaaaaaaagacgatttttcgcgggtgcctgacgcgttgatgaaaggattcggtcagccgcagttagcgatgatgctgccgcttgatggacgtaaaaaattagtcaatgccgagctcgaaaaagtaaaacaggcgttaagcgagcagggctattatttacaattgccgccgccgccggaagatttgctgaaacaacatctttcttcggtgggacaaaatacgtcgcacgctgaccgttaaacggtattcggcgccgcgcctgaattccatcatgatcttaggggaaaatatgtatcaacatcgtaactggcaaggtgccttgcttgattacccggtaagtaaggtggtctgcgtgggcagtaattacgcaaatcacatcaaggagatgggcagcgcgacgccggaagaacccgtgctttttatcaagccggaaaccgcattgtgtgatattcgccagccgctggcgattccggcggatatgggcgctgttcatcatgaagttgagcttgccgtgctgattggcgcaacgctccgccaggcgaccgaagatcatgtacgtaaagcgatagccggttatggcgtggcgcttgatttaaccctgcgcgatattcaagggaaaatgaaaaaggccggacagccttgggaaaaagccaaaggtttcgataacgcatgtccgatttcaggcttcatccctgtcgcggccttctgcggcgatccgcaaaatacggttatcggacttaacgttaatggcgaggttcgccagcaagggtcgaccgcggatatgattcatcctattgtgccccttatcgcctatatgagccgctattttacgctcaaagccggggacgtggtgctaaccggcacgccggcaggcgtggggccattattaagcggcgatgagctggacattcgttttaatggcgaaacgttgtctactcgcgttctgtaaaatctgcttgccgccttcagcggcggtaaaacttgcatctgcaggccagactggttataaggtgcagctttaatgcaatggcggatactttaatgagcgatacacctttctggcaacgtaaaaccctggatgaaatgaccgatgccgagtgggagtcgctgtgcgatggctgcggtcaatgctgcctgcataagctgatggatgaagatacagatgaaatctacttcaccaacgtggcgtgcaggcaattaaatatcaaaacgtgccagtgccgtcattatgaacgccgttttgaatttgaacccgactgtatcaaactcactcgcgaaaacttgccagactttgaatggttgccgatgacctgcgcctaccgtttgttggcggaaggtaagcccttgccgacgtggcatccgctgcagactggatcgaaagccgctatgcatggcgagcgaatttctgtccgtcatatcgcggttaaagaatccgaagtacgggactggcaggatcatattttaaataaaccgtcgtgggcagaataagtcttcggcaaaacggctgattgtttacaattctttaatttacgctgggcggcccctgaaatcaggaattgcgtgcaaattccgtcacctggcgttatcactgccttctattcttccctgacgcgccttgtcgctgcgctcgcgcacgtatggcggcgactctatactttcaaagcagtatatcgctgcctatcctgaggagttaccccatgaataaccaaccgttgcgcgtttcaaaggatcagcccaggaagcctgataagacacccgaagacgaaggaaaaaatccaaagaaaaaccaaaagtagtgctgtagggtatctttaataactatggttcgttggaggctttatgtctgaacgtcctgatttagtcgatccattaccagaggatgagccgcttcctggtgaaaatattccggatacgccagagggagacgatcctctcgacccggatacccagaatgaggttgaagatcctcgtagatagcgtcttgtgctattaaccaaccgcctgatgcaccgtctgtgccaggcggttttttgcatcttctaaagcgaaacatcctgataatcctcagaaagatagcctataattttttgtacgttaaaatagtagcgcgtccatgacgacactgtcttattgcgcttagccgtttgcgagttcaaaggaggaaatcaatgaacagcgaagagttgacacataaagcagaagaggaaatcgcggcactcattagcaaaaaggtcgccgaactacggaagaaaaccgggcaagaggtttccgaaatagagttcgcgccgcgagaaacgatgaaagggcttgagggataccacgttaaaattaaactactctagcgtttaattagcgccattaatcacctggctactgggcgggacgccgcccagtggtaactggtttaccgatgtcaggcttttttctgttgatacatttcctcgccctgatggtcttcctctacccaaaaatgaatgttgaaccgcgcatcatcgctcagctctacccgatgccagtattgcggcggactggtggcgaattgcccggcattaatcaccactttcacttctggttctgtcgcggtttcattcgcaaagccatagtaggtcacggtgccttccatcacgcagagttgtccgaaaacgcctgccgctgtgttgtgatgagagagcagtgccgccggaacattctctttggtgtaaaagggggtagagcgtttaactttccagtttgccgggatgcgtaagtgggacataagacatctccctgatgtggtgattaaaagatgtatttaatatacaccttttaatcactggcaaacaacgcttcgggcaaaaaaacgctcccgaaggagcgtgtgtatcaacgaccgaacaggtcgcgttttttaggcttaaatgcctgagctatgacgacagctatcgctaccacaaggtaagcggcaaagatccccaacagccattgcggcatctccagcgttaaaaacgaccactggcgctcggcgcaatcaccggatgccacaaacacctgcggtagccatttacccaacggtaaccagtctggaaagcgcgccataaagtcacaggtcatgaacggcgagggatgcaactgaatcatcgtatgttcatacgccagttgtagaccccgccaggcgctgtaaatccagataaccattgccacgtatcgcagcggcgttttcggcgctattgcgccgaccagacccgcgcccatcacgccaaacagggcgcaacgttcgtaaatacatagcacgcaaggtttaagtaacatgacgtgctggaaccacagcgccaccatttccagcgccagggcggtaaacgccatcagtaaccatgcgccccgaccccgtgagcactggtttaaaaatcgcaacataataatttccctgcaacatgcgtagagaccgcagtgtaaaccaattcaattcgtgcgccactagcgggaaatgaaataatgtgtaattggataattatcaggcaaaaatcggagccgggcggtgtattgcccggccaaacgttacgaaagcgttgctaaccatcctgcctgagtcatccattcggtggccggcgcaagagtgaattcgacgcacagtagccctatcagggtcagtacgatagtgtacggtaacgccatccagaccatacggccataggagagacggattaacggcgccagcgcggaggtcagcaggaataagaatgccgcctgaccatttggcgtcgctaccgatggcaggttagtaccggtattgatggccacagctagcagctcaaactgttttaagctgattgcgccgttttccattgccgccttcgcttcgttgatataaatggtgccgacaaagacgttatctgagatggaagacaacaggccgttaaagagatagaacagcgttagctgtgcgtgttcagaggcttgcaagacgaactgaataatcggcgcgaaaagatgttgatcgataataaccgccacaatagagaagaaaacggttaacagcgcagtaaacggcagcgactcggtaaacgctttgccgatggcgtgttcatcggtgacacccgttaacgcggtggccagaataatgaccgacagaccaatcagtcccacctccgcgagatggagggcgagggcggtaaccagccagacgccaataaccgcctggactattagtttaattttatcctggcgggtgcgcttcttacggctttgatcgtcgaattgctgcaagacgtcgcggactttttcgggcaacgtttcgccatagccaaaccagcgcattttctcgaccagcatacaggttaacagtccacataccagtaccgggacggtgacaggcgacatccgcaaaaagaagtcgccgaaatgccagccagcagctttagcgatgatcaggttttgcggctccccgaccatggtcatgacgccgcccagcgccgtccccacgcctgcatgcatcatcagactacgcaagaatccgcggaattgctccagcaccgttttgtaatgcggatcgatatggctgtcgtccagcatatcgttctcttcgccgcgcgatgaggccacacgatggtaaatcccgtaaaaaccgacggcgacgctgatcaccaccgcaacgacggtaagcgcgtcaaggaaagccgacaagaatgcggcggcgacgcaaaaggccagcgacagaaccatcttcgagcggatactgagtaacagacgggtaaaaataaacagcaataactgcttcataaagtagatgcctgccaccataaacatcagcagcagcaagacttccaggttggcggcaacctcttcacgtacatgggcggcgctggtcatgccgatgataacggcttcaatggccagtaacccgccgggcagcagggggtaacactttaacgccatcgccagggtgaagataaactctgccaccagcagccaaccagcaacaaagggattagctaagaaaatgaatgggttaacaattaaaaagacaagtagtgccagtttgtaccagtcgggcgactggcctaaaaagttgcgccacatggcgcgaccccatgagatctccatgaaatttttccttacctagaaaaatgaaatagcgtttttatgtttaaacacagagagtagcgagcgcgacgaatgcaagcaagtccttaacgatattggcaggcgatatcagaaatggtgccttgatcccctttttcttcattgcgtccgctatcaggtgttacgcccgtctggtatgatgagtacaactatgttttgctgtgtaatggaaatctcactatggtcattaaggcgcagagccccgcgggtttcgcggaagagtatattattgaaagtatctggaataactgctttcctcctggcacgatcttaccggcagaacgagaactctccgaactgatcggcgtgacgcgcacgacattacgcgaggtgttacagcggctggcgcgagatggctggctgaccattcagcatggcaaaccgacaaaggttaataatttttgggaaacgtcagggctgaatatccttgaaacgctggcccgccttgatcatgaaagcgttccgcaactgatcgacaatttgttgtcggtgcgtaccaatatttctactatctttattcgtaccgcattgcgtcaacacccggataaggcgcaggaagtgctggccactgcccacgaagtggccgaccatgccgatgcattcgccgatctggactataacatctttcgtggtctggcatttgcctccggcaatcctatttacggcttgatcctgaacggcatgaaagggttatacacccgcattggtcgccactatttcgccaatccggaagcgcgcagtctggcactgggtttctatcataaattatcgtcgttatgcgagcagggcgcgcacgaccaggtgtatgaaacggtgcggcgttatgggcatgacagcggcgagatttggcatcggatgcagaaaaatctgcccggcgatttagcgattcagggacgataatcccgcgatgcccggtagacgcaaacactaccgggcagcatctcgattacagcgtgttcatgcgcggcggacaacgctccagcagttctacgctgccatcctcattttgttgctccagcatcacatcaaagccccataaccgatgcacatgtttcagcacctctttgcggcctttatccagcggcgcgcggttatgcgggatataacgcaacgtcagcgatctgtcgccgcgtaaatccacattccagacctgaatattcggctccaggttgctcaggttatactgtgacgacagttttgatcgaatctcccgataaccttcttcgttatgaatggcggagatctccagataattatgcctgtcatcatcaagtaccgtgaagaaacggaaatcacgcatcacttttggcgacaggaactgactgataaagctttcatctttaaaatcgcgcatggcgaagtgcagcgtttccagccagtcggaaccggcaatatccggaaaccagtatttatcttcatccgtgggcgactgacaaatacgtttgatatcctggaacatggcaaagccgagcgcataggggttaattccgctataccaggggctattatagggcggctgaaatacgacattggtatggctgtgtaaaaactccagcataaagcgttccgtcactttgccttcatcatacagatggttcaggatggtgtagtgccagaaggtcgcccagccctcgttcatgacctgcgtctgtttctgcggataaaaatactggctgactttacgcacgatgcgcagaatttcgcgctgccacggctcgagcaacggggcgtttttctccataaaatagagtaggttttcctgcggttcagcaggaaagcggcgtgcttcggcgacagttttttcttcctcgcgttttggcagcgtgcgccacagcatattcacctggctttgtagatactcttcccggcttttttgtcgcgctttctcttcctgcaacgagattttctgcgggcgcttatagcgatcgacgccgtaattcatcagcgcgtggcaggagtcgagcagtttttctacttcatccactccgtagcgttcttcacagcgggtaatgtaattccgggcgaaaatcaggtaatcgacgatagagctggcatccgtccagctccggaagagataattatttttaaaaaaggagttgtggccgtaacaggcgtgcgccatgaccagcgcctgcatggtgatggtgttctcttccatcaggtaggcaatgcagggattagagttgatcacaatttcataagccagtccttgttgaccatgcttatacagacgttccgtctcaatgaactttttgccaaacgaccagtgcggatagttgatcggcatcccgacgctggagtaggcgtccatcatctgttcggaagtgatgacttcaatttggtgcgggtaagtatccagttggtagagtttcgccacgcggtctatctctgccagataaacatccagcagatcaaatgtccagtcggggccatcgctcaaacgtgtggtgtccttgttcatggaatcaatcattgccattcgcgcaccctcattgttggcgacgctctctgtatggagcgcctcctttcaagcatagaacaccatgttaaaaaacgacttgatcgtgaaaacttttctttgcgatttcctccacattgaacggcaaaaaatcgggtattggcatcattttatgctgtatagccatgccgcgtagcaggagatcccaaaccaatgggatcgcttgtctttagggtatatgtgaagcacgtcaccataaaaaagtcatatgttgaataatattttcatctgagttatcaagatgtaatcagaagattgttcttttactattaacggagtggctatgcgagttgtcatcctggggagtggcgtagttggcgtgaccagcgcctggtacttgagtcaggcggggcatgatgtcaccgtcatcgatcgcgaatccggcccggcgcaagaaaccagcgcggcgaatgccggacaaatttcaccgggatatgcggcaccctgggcggcccctggcgtaccgctgaaggcgataaaatggatgttccagcgccatgcgccgctggcggtgcgtctggatggcaccccatttcaactgaagtggatgtggcaaatgctgcgtaactgcgatacccggcattatatggaaaataaaggccgcatggtgcgtctggcggaatatagtcgcgactgcctgaaaacgctacgcgccgcgaccggtatcgaatatgaaggccgccaggggggaacgctacaactcttccgcaccgcgcaacagtatgagaacgccacccgtgatatcgccgtgctggaagatgccggggtgccgtatcagctcctggaagccagccgactggcggaagttgaacccgctctggctgaggttgcgcataaattaaccggcgggctgcgcttaccgaatgatgaaaccggggactgtcagctctttacccagcgtctggcgcgcatggcggagcaggcgggcgtaacctttcgctttaatactcccgtggaaaaattactgtacgaaaatgatcagatttacggcgtgaaatgcgccgatgagatcattaaagcagatgcgtatgtcatggcgtttggatcgtattcgacggcgatgcttaaaggcattgttgatatcccggtgtatccgctgaaaggctattcattaaccatcccaatcgtcgagccagacggcgcgccggtatcgacgattcttgatgaaacctacaaaatcgctattacgcgttttgataagcgtattcgcgtggggggaatggcggaaatcgtgggctttaataccgacttactgcaaccgcgccgcgagacgctggagatggttgtgcgcgatctttttccgcgcggcggtcatattgagcaggccacattctggaccggcctgcgccccatgacgccggacggcacgccggtagtaggacgcacccgttataaaaatctgtggcttaatactggacacggcaccttaggctggacgatggcctgcggttcaggccagttgttaagcgatatcttgttgggtcgtacgccagcgataccctacgacgatctgagcgtggcgcgataccgttccgattttacgcccacccgcccgcaacgtttgcatagcgcgcataactgataaaggaagtgaaatgacccgccctatacaggccagccttgatttacaggtaatgaaacaaaatttggctattgtgcgccgggcggccccggaggcgcgcgtctggtcggtagtgaaagccaacgcctacggccacggtattgaacgcgtctggagcgcgctgggcgccacagatggtttcgctatgctcaaccttgaagaggcgattaccctgcgtgagcgcgggtggaaagggccgatattgatgctggaggggtttttccatgcgcaagacctggaggcgtatgacacttatcggctgaccacctgcatccacagtaactggcagttgaaagcgctgcaaaatgcgcggcttaacgcgccgctggatatctatgtcaaagtcaacagcggtatgaaccgactcggttttcagcctgagcgggcgcagaccgtctggcagcaattgcgggcaatgcgcaatgtcggtgaaatgaccctgatgtcacattttgctcaggccgatcatccggaaggtatcggggaggcgatgagacgtattgcgctggcgacagaaggcctgcagtgtgcatactcgttatcaaattcggcagcgacgctgtggcatccccaggcgcattatgactgggtcaggccgggcattattttgtacggcgcgtcgccgtcaggacagtggcgggatattgccgataccggactaaaacccgtgatgacgctgagtagcgaaattattggcgtgcagacgctgagcgcgggtgaaagagtaggctatggcggagggtattctgtgactcaggaacaacgcattggcatcgtcgcggcgggttatgccgatggctatccacgccatgcgccgaccgggacgcccgtgctggtggacggtatccgtaccagaacagtaggcaccgtttcaatggatatgctggcggtggatttgacgccgtgtccgcaggcgggaatcggcacgccggttgaattatggggcaaagaaattaaggtcgatgatgtcgcctctgcggcaggcacgctgggctatgggctactgtgcgccgtagcgccgcgcgtgccgtttgtgacaacgtaacctaactcaggctaaggcgtcgaccggtccaccgggggcgggtcgacgttgtccggcgaccttattctgcttcgtcttcggcgacgcgtaccccaatcttgcgtaccacgttatcttctttttcagctaccgtccaaatcatgccgccaaactccacctgatcgccaacgaccggcgcagcgcccagcagctgctgtatgatttcaccgagggtttgttgtttatcccggtattccgttccttcttccagcccgtagataagcgccacgtcggcgaatttcgcgttcgcttcgaggataaaatcgccaaagaaacgctgatctaacgaaaccggcggcgactggctaaacaatttgcccagcgctggcagatcgcgctcccggccaatcacgcagagtacgtcgccttcctgcaggcgagtgctacccgtggggtgaaacagttcattattgcgaaatagcgcggcaatgcgggtttcgttcggcatatgcaggtcgcgcaacgccgcgccgacgcaccatttgtcggcgctcaactgatagatgaattgttcccacggattatcaggatggatgtcaagccccacgcgcgatactggccagccaaccggaggcacgaccactttggctctcttcgccgcccatgacagcgatgttccctgcaggagcagcgacaccagtaccacaaagaaagcgacattaaagaacaggcgagcgttttcaagcccggccatcatcgggaaaacggcgagaataatcggcaccgcgccgcgcagtccgacccaactgatgaaaatgcgctcccgaagattgaagccgcgaaaaggcagcaggccggtaaataccgacaatgggcgggcgaagaaaatcatccagatagagagaataagcgcagggacggcaatcggccacagatcggaaggcgtcaccagcagtcccaggaccaggaacatggcgatctgcgccagccaggccagtccgtcaaagttttgcaggatgccgtaacggttgcgaatcggacggtttcctaacaggaatccgcacagatagaccgcgagaatgccgctgccttcaagcgcggtcgtcaaagcaaaaatcagaataccgccgctgagcgccagcatcggatacaggccgctgggcagagaaatacggttgatcatctgctgtagcaggtaaccgccgccgaggccaaaaacaataccgagaccgaactgctggataatatggacggcaaacatccagtccaggccggtttcatgtttctggatcatctcaattaatgtaatggtcaaaaaaacggccatcgggtcgttacttcccgattcgatctccagcgtggagcctacacgttcgtttagccctttgccgccaagcagagaaaagaccgctgcggcgtcagtggaaccgactatcgcgccgataagcagaccttcgataagatccagatgaaacagccaggcggccatcatacctgttaaccccgacgtgatcagtacgccgagcgtcgccagcgacagcgcggggcccagcgctacccggaaagagctggcctgggtgcgcatgccgccatcgagtaaaataatcgccagcgccaggttactgaccatataagcgaaaggataattatcgaaaggaataccgccaatgccatccacacccgctaacatcccaatggcgaggaaaatgaccagaatcgggatacccagtcgcgatgagaatgaacttaacaggatactgctggttacaaggatggaacctaaaataaatagactaataattgttgcagcatccaacgttttatatctcctgactcacacgacttcgtattatttaacattaacataataacggccagggcagcgttttacttagcctgtcggggactttttttacaattgcagcgtaggatgaccagataaagtgagttgagtcccctggcgcgtatttttaagcgttgcgtttgccccgatagggagcgtcaccgtacgctgttcatgcccgaagtcgagaccggtaatcagcggaacggacagacgggaacgtaaaaacgcgtagacgctctccagagaatagccggcgtcatactcgttgggcgccgcgccgctaaagctgccgagaacgatggcgctctgacggtttagaattccggcgtactccagttgcaaaagcatacgctccacccggaaaggatgctcattgacatcttccagcactaaaattcctttatcgatagtcggcatccagggcgtaccgataagggaaatcaacatcgccagatttccgccccataaggtgccctgtacgtcgcactgagggccgtcgccttgccactctacggtaaattgcgccttgcgtagcgccagccagaaatgttgctcggtgaacgtattcagcgtttcggcgccaaaatttgccgccagcataggaccgctaaaggtgatgacattggcctgcgccagtagtccagcctgaatcgccgtaaaatcgctatgaccgcaaatcagtaagggatcgcgctgttgccgggaggcgagcgcctgccagtcgatacgatccagcaagcggctggcgccatagccgccgcgaaccggcatgacgatcgtatccggcgaagttagcgaggccagcgaattaacatcggccagccgttccgcgtccgtaccggcaaaacgctgatagcggcgacgaatcacctcgtcattctccacctgatgacccgcgtcagtcaggcgctgaacgccgcgtaacgcggcctgttggttaatacagtagcccgagggggcgattaaatgaaacagagacatggtaattccttgctgacaatagaatgcaaatgtatatcatgccgcatatattaggcgatgtccctcgttgtgcgacgtttctggatgcgcaccagggaggcaacctaagtacctggccggggcggtataacctcttcggcagataagttacggctataaggatagatgacgtgaaattaagatggtttgcttttttggtagtaatactggctggctgtagctcaaaacaggattacaggaatccaccgtggaatgccgaagtgcctgtaaagcgtgcgatgcagtggatgcccatcagtgaaaaagccggggcggcatggggggttgatccacatttaatcaccgcgattatcgccattgaatccggcggcaaccctaacgcggtcagtaagtccaatgcgattggcctgatgcagttaaaggcgtcgacttccgggcgcgacgtttaccgtcgtatgggctggcgtggcgaaccgaccaccagcgagctgaaaaaccctgagcgtaacatctcaatgggcgcggcgtatctgagcattctggaaaatgggccgctggccggcatcaaagatccgcaggtgatgcaatatgcgctggtcgtctcttatgctaacggcgcaggcgcgttattgcgtactttttcatccgacaggaagaaggcgatagaaaaaattaacgatctggatgctgacgagttttttgaacatgttgttgataatcatcccgcgccgcaggcgccgcgctatatctggaagcttcagcaggcgctggacgccatgtagtttagcgtgaagattattctcgcactttattcgctctttctcgggcgtcgcgctcaagcgaaaaaataatccgctgcaactcccgctccaccgccgggctaacgttaaggaaacgaaagctcaggcggggagtggtgatcgtttcatttttcccatcaatcaccttacgctcgctgatggcgagaagctgggcgtcaacgtgaagaatcccccatggccccatgttcagttcaacctgcgaaaagcgtgcgccttcgattagtccgtcggggatggcggattccagtagcgcgcccatgccgcccagggaaagatcaaacaggcgaaaacgtaacgtacgggtgtccggtagcgtggtgacgccgtaataaggcggatacagcggcgcgccaatgcgaaaatactcccggcgctggacaaaccacagtgatgacggcaggggcgtgataaaggccggcagccgctgatattcacctgtaacgagttgcggcaacgtgaactcgacttttgcgccttgtgtttctgcgataatggctacctgcccggcgcgtaatacggcgctatttttatattcctggctgccgtaatccacgatgagtttttccggggctaccgccaaaattttactaatgaattgaccatgcgcccatgaaatacgcagtggaacctgatttttatttaaatcccgtagcacgcctaatatcgctaatggattttttttcaggaactgctcattgtaaccactcacacgaaataacccctgatacgcagactatcgttgggttatcggcatcagtagaaagaacttaatagcgataaataaatttttatgtccgcgagataaatcagtgttcagaaatgcgacgctcgactttgcctatacttaaaacgtttttactggaaagagggttcgcaaatgggaattatcgcctggattgtttttggtttgattgccggcgttatcgccaaattgcttatgccggggcgcgatggcgggggatttatcctgacctgtattctcggtatcgtcggggcggtcgttggcggatggctggcgacgatgtttggtattggcggcagtatcagcggctttaatctgcacagtttcctggtcgccgtggtgggcgcgattgtggtgctggtgattttccgccttctgcgacgcggctaaccgctgcagaacgtgtaagcgttgacccggtcagcgccgggtcaacctactataaacacgcgttactgcgtcgctgcagacggcgtttttgtcggcgttgcgcttaacgatgccggacgagtagacggtacgctatcgcacggtttttcctgcggacaaatcagatcgagcattttcagcgtcacgccgttgctccagccaaagccgtcctgaaggggatattcgccgccgccaccgccggttccggtactgctgacgtcatatttttcgaccagttttttctcgcgatcgtaggtgtgctgcacattggttaaaaagcgccaggtgacttccattgccacgtcatcctgcccataattttgcaatccttcggcagcgacccattgtaacggcgcccagccatttggcgcatcccactgctgtccgcttttaaccgaggtggtagccagcccgccaggctgtagcagatgcgcctgggccgccgctgccactttcgcggcgcgatctttcgcggcggcgtttacatagagcgggaacagcgcggcagcggtgagttggtcacggattttattgttctgcagatcgtagtcggcataccaaccctctttgttattccacagatgcatttcaatggctttttgccgcgcgttggccagcgcgtcatattgcgaggctttggcccgatcgcccgccgcagcgctggcgcgggcgagggttttctccagctgatacagcagagcgttaagatcgacagggacaatcgtggtggtacgaatggtactgagctgctgcggattatccatccagcgggagctgaaatcccagccggaggcggcagcagatcggaggtctcgatagatctccgttgccgggcggctggggttgcttttggcggtagcgatatcttcaacccaggattcagggcggggcgtatcccgatcgtcccagtagcggttgagaacgctgccgtcctccagtttgacgacgcgttggttttgttgccctggctgcaatgtctcaacgccctccatccagtaggcgtactctttttgcagttgcggcaggtattctttcagcgcatcgtcaccttcatgttgcaccagtaattcaaccataaacgcaaagaaaggcggctgtgaacgactcaggtagtaggtacggttgccgttaggaatatacccccaggcgtcaatttcgtaaccaaagttcgctaccatatccgccaccttatcccagtgcccgctttccgccagccccagcatcgtaaagtagctgtcccagtagtaaatctccctgaatcgcccacccggtacgacataggattcaggcaacggcaagagcgagtcccacttttcgacgtttttagttgaacgggtcagcaccggccacaggccatcaatatgttcacgcaatgattgcccggcaggcgggacatatttttcacccgctttcggcagggtgaagttaacatcaacaaaatgacgcaaatcgaagccggactagttccgctgcatacgataatccgcaagaatcatgagcggatcgctattaggtatggcgtcagcaaaggttttctgatcggggaagagttttgcattctggacatcattaaagagcgggccaagcaaaatatccggcggctgcggagtttcagtgtcggaagacgggtctgcggcagtcgccgaaaacgatgcaaacgtcagcagcgtccctgccagcgccagttttatggctttctgtagtagaacagaacggcgaatctctgggggtatcatcaagttatctccttagcagtgagccaaagccaacggcatttaccatgacaaaaccttagtctacgatgaccagatacgcgtgattgaaccgctattttgcgaacaaacagacattttattgagacagaatttatcggcgcgcgcgtggaaaacggggtatacagacaaaaaatccacgccgggacgtggattttagcgcaatgatttgtcgccttaacctggatagataccgcgatctttacgggccagcagaatgcgctcacaggcgacaatataggctgcggtgcgcagagaacaggatttctcagccgctttctcccagacatggacgatcgcgtcggtcatgattttgtccatgcgcgcgttgatctcttcttcgctccagaagaagctggccatatcttgtacccattcgaagtagctgacggttacgccgcctgcgttacagaccacgtcaggcaccacaaggataccacggctggccagaacatcatcagcatccggataggtcgggccgttagccccttccagcaccagcttacacgtcagggcttccgcgcgctgacgagttatctggccttcaagcgccgccgggatcagaatatccatctccagacgccagaacgcatcgctggcgatagtttccgcgcccgggaaaccggctatctgtttgtgttctgtctgccatgccgtgagcgccttcatgtcaataccggtggcgttaaacagcgtcgcggtatgatcctgaatcgccacgacacgggcgccagcgcctgcaaacagacgcgcggcttcgctgccgacgttaccaaaaccctgaaccgcaacgcgagcgccttcaacggcgatattcgcccgacgcgcggcttccagcccgctgacgaaaacgccgcgccccgtcgccttttcacgacccagcgaaccgccaagatggataggcttaccggtgacgacgccagtgaccgtcgtgccatgattcatggaatacgtatccatcatccaggccatcactttaccgttggtgccgacatccggcgcaggaatatctttctgcggcccgatgataatgccgatctcgctggtatagcggcgggtcaaacgctccagttcaccttccgacagcgagaacggatcgacgcggatgccgcctttggcgccgccgtacggcagattcagcgcggcacatttgatggtcatccatgctgacagggccatcacttcattgagatcaacgtcaggatggtagcgaacaccgcctttacccggacctcgggagaggttgtgctgcacgcgatatccttcgaaatgacgaatagtgccatcatccatttgtaccggaatatcgacgatcagagcgcgttttgggtggcgcagagtatccacctagggggataactcgcccagataaggggccacacgctcgatttgttgcaggtaggtattccaggcagatgtgctgctatctgaagcgtaagataacttatccatgataaaccttagtgataaaagtaatatgttctttaattgaccgtggtacatagtagatcacaccatgtagcgataaatttaacactttttttaaacaattaactcagatcaaaaatggcaggcagttggattttcgttatgattttggatgagaagtggttaactatccgctataagaggtgatatatcgctaattatgcaattaattgcttaaatatgcgtgatatgtgcaaggcggctatttgtcataattatgacgcacctctaaaagtaaagattatgataacgacatgtatcaatgttatgtcgtcctgtcggcggggaaacgtcttcgccaggcgcgtaaaaagataaaaataaccggagtcagacggctctgaccccggtttacctctttattgttgacgcgactcaagccacaccagcaccagcgtcgacagtgagcacatcagcagaatgccgacaaaccacagtaaataccacatcgctctcgctccctaataaagttcatgatcgttgcggcggagggtctccaggttgatacgccccaacattttgtaatagctccacagcgtatagagcagtacgattggcagaaaaatcagcacaatcaccagcatgatttcgagcgtcatctggctggaggtgctgtcccacaccgtcaggctggagagaggactaacactcgacggcatcacaaaaggaaatagcgttatgccggcggtaaagatgacgcaggcctgggtcagggaagcgaacagaaatccacgaatagtctgaccgcgaaggcaggcatagaaagccagaatcggcaggatcataccgagcaacgggatgatgagcagtagcggcgagcgtataaagtggttcatccatgcgccagggagtatcgccacgccttttaagagcggattggaagggccgttggcatcctgcgtgagtaagacaaagccatcaacgccggcccacagccagtaaccggccagcaggaagcagatcacgatcagcagcgcgctgtggcgggtggccgacagagcccgttgacgaataacgccctccgttttcaactgtaaccagacgcctccttgcataatcaccaacgacagactcaataatccacacagtagggcaaagggcgagagtaactgtcagaaggtgccaaaatagtcaacatgaagctgcggcgtgaaggcaaacggcacgcctaaaaacaggttgccgaacgcgatgccgaatacaacggggggcaccaggctgccgataaccagaccggtatcccacagcgcgcgccagcgggcattggcgattttaccccgataatcaaaggccagcgggcgaaggaagagggcacacagcaccaggatcatcgccacataaaaaccggaaaacgcggcggcatagacccgtggccaggcggcgaataatgccccgcccgcgagaatcaaccatacctggtttccttcccagtgggcgccgacgctattgatcaatacccggcgttcgtcatcgttgcgcgctatcagcgggagcaggcaaccgacacccatatcaaacccgtcagttaccataaatgccactaggatgacgccgatcagcagccaccaaatgaaccgcaacgtttcataatccaacatgattgtctcctttatccctgttgttgcgcttgttgttgatgttgcatggcgctcggcccaagacgcgcgtacttctgcatcagatagacttccgcgattaaaaacagggtgtaaagtccgaggataagccccattgagaaggccaactggcccggcgtcagcgcggagtgagcgtaccaggtcggcagaatgtcctgaatcgcccagggctgacggccaaactccgtcataaaccaaccggcttcaatggcaatccacggtaacggcaggctccacagcgtcatacgcaatacccagcgatgctggtcgatacgcattcgcagcgtctgtatcaacgcaatcaacatcaccactaacagcagcgaaccgcagccgaccataatacggaaactccagaacaccggcgccacctgaggaatagcgccacgctgggccgcacgatactgctccggcgtcacatggttcatatccggggcatatttcgccagcagaatgccgtaccccagatcgccctcaacggcgtgaaacgcattcagtacctgcggcgagcgattgccttgcgctatctcctgcatgagtagccaggcctcccggccacgcttcaggcgcggcagagcgtcgtccatcaggttttttaaccccggaaccggcgtatccagcgaatgggtggccagaatacccagcagagcagggatcttcacggcaaatgcattacgctcctgttcctgctgcggccaggcaatcagatgaaacggcgcgggcgcgggttcggtttgccattcgccttccatcgccgccagtttcaccggctgaatttgggcgacctcgtaggccgaactgtcgcccagttgcagggttcccagaatggccagggtgccgaatactgagccgatagcaaacgagcgcaaggccacctcacgctcgcggccacgtagcagatacaaggcgctgatagacataataaacatggcgccggtgacataaccggacatgacggtatggacgaatttcacctggctcaccgggttaaagaccagatcgctgaagctgctcatttccatccgtaacgtatcgatgttgaaatgagcgccggtaggatactgcatccagccattggcattcagaatccataatgctgaaatattggagccgaaggccaccagccaggtgaccagcaggtgttggtatttattcagccgctgccagccgaaaaagaacaggccgacaaaagtggattcgagaaagaaggccagtaacgcttccatcgccagcggcgcgccgaagatatcgcccacatagttggaatagagcgaccagttagtcccgaactgaaactccatggtcaggccgatagccacaccgagagcaaaattgatcccgaagagcttgccccagaaacgcgtcatatcgcggtagacggttttccccgtcaccacatagatcgtctccatgacggccagcaaaaaaatcagcccaagcgtaagaggaacaaataaaaagtgatacagcgcggtcagcgcaaactgccagcgcgataagtcaatgacatcccacatgctaactcctgtaggcagaaagagagtaaaaagctaatcaataccggacaccggtgacgttcctgttgagagcgctagcgcgtctccagccatcggcagacttcatccaggcgctggcgcgaatcggccagatcttccggggccgccagtaccagctccggcaaaggacaaatctcatagctatcgagcaacggccctttaagggcgtccagacagcgcacatgccagagatggcgcaatgctgtggcgttgatttggctttcgccatacccggagatgcgaatctggatgttcccgtgtccgcataaacgcgccagaaaaagacgatcggcctcgctgagcggcagttgggtcaaattgatgctgtgaggttgcaacgccggatcgcgtacgtgcgccaataactcatgggccagcggcagtccattcatcaggccagcgacaggcggaggcagcagagagtcgtcaggcagcgtatcggcagtcgccgcttgccacaatgtcaggggcgcgctacccgcttccagacgatccgtcagcagacgtcggttatgcagatggcgtacccgccacaggccgcagaagatggtctcctggatctcgctttcactcccgtccggatgctgaatgcgtaccgagacttcgccttcgcccaatagcgtattgaggaatgagagatcatcggcattcaggggagataactcccatcccagcacgtcgccgacttccgggatgcgccgggcaagctgacctcgcagatcggtcaacaatgccatcaccgccgggctgtgagcgcagcgttccagcgccgccatacttgggtcgccattgacctgacaggtgagcggtaggggattcatcgagaaactggcgtcatcaggctgcgtgcctggccccagcagatgaaaaaaggcgttgctcattgtgctgtctcctgcgctgcgggagtgtcaaccatcgaacgcatcagcgtgagcagttcagcccagggatgaatgccgctgagcgcgccgcgtagctcgccgtctgtaaaaaccaacgtcgccggaaaccgacgtacattaaagcgatcgccgatagcttcgctttgttcaaggtcggccaccgccacctgccagtcaaactgcgggaactcacgcaggagttcggcaatcatcaccgggttatcgctgacttccggcgtacgccgcggatcgctacttaacaggatgacgccatctccaatccgtttgatccagtcgtctaccgtggaagcctctaccggttgccatccacgggttaacaggcgttgccatagcgcagagaacggggtgtcattcgccacttcttttgccctccagacgtgtctgatactgacgtatgcgcactccctcataattttccatcgacaggcatttatagttcaggcagcgtgcgacctcatttgcctgcggtacgatcccccaggcggccagttgcgccagggcggcctgttctgccgccggtagctggctgcgagctatttcgctcaggctaccgccgtagtcgtccagtagcgccggttgcaggccgaccagcgcaatgtgacagggcagatgtccgcggatgtcggccagcgccagaacttcggaaaaactgttttgatgcaggctcatttttttggcgctgagatacgcggggattttctcgccggcataggttcgcaggctgcccggcgccaggccgtaatcgatcgcgtcaaggagcaggagatggctggcttgctcaacataacctaacaggtttagcccttgcgtaccgccgtccacaatttctacctcttcaggccagtgatatcgggcatacaaacgctccgcgacccggataccgaatccttcatcggcccacagcaggtttcctaatcccatcaccactacacgttgcgcattcatgagggctccttgtcgtgcggtttggggaatttgtggctgcgatagccattgatcatggtggagatcaccgtatcgtcggacataatgtcttcccggatagcgaggtaaacgtgcccgacgatgaaggcggcgatcagccacatgcccagtcggtgccagctgtgaatatcgatggagttgccgccggtccagtagaaaaattcaaccacatagcggaacggcgcaaagatggcatactggctatgctcgccaaacagagcgaaaccggtgaggatcataaataccgataacaggaaatagccgaacatcgcggcctgcgcgataggattatgtccgatgtcgctccccggttttttctccagaaacagataccagcggaccacggagaaagcgccttgccaccaactgcgacgccagaccgggacgataaacagctctcgcgaatagcggttgccgacacaggcccaataaattcgccccagcagtaacacgataaagatcatcgcggcggcaaagtggatcagccggatatagcccatgtaaaacagataggtcgcctcgccactcaccgacggcagcggtcggccaatgaagtagcctgttaccatcagtaccaacatgcaggccaccgttagccagtgccacaggcgtaccggcgcttcaaacacatagtggctgacggcagtatcacgcgcctccccgacgcgtggagatagctttccagtcatcgttcttttccttaacgcttagcgtacctggacggcaatcagttcgctgccgtcgtcgccgagcacgtgggttgaacaggcgaggcaggggtcgaagctgtgcagcgtcctcaggatttctaacggttggtcgggaatcgccatttgcgttcccatcaatgccgcttcataggcgccgatctgttttttaggatcgcgtgggctggcgttccaggtggtggggactacgcactgatagagttcaatcttctgatcgcggattgacgcccagtgtcccaacgctccacgaggcgcttcggtaaaaccgatgccgcggcagtgctgcggccaactggccggttcccatttctcggtattggcggtggccaggtcgccgtttttcaggttggtcataagcctgtcgaaaaaatactgcagcttaccgacggcccattgcgcttcgtgcgcgcggcataaaatacggccaagcgtagactggataccggagagcggcagtttaagggcagacatcatgcgatctaccgactctatggtggcggcatcccctttgtgatacgcgataagcgttcgggcaagcgggccgacttccatggcatgaccccgccagcgcggcgctttaatccaggagtagcgttcctgctcgttgagctgctggatatgcgtatcgctgcctttgacatcacccgggttgtaccagggatcggtaatgccgtcaaaaggatgacggcccagccgatcgtccggatagcggtaccaggcatgatccacaaactcctgtatctgctgcggatcggccaaatctaccggcatgacatttttaaaatcgccattgaccaccgcgccgcccggcattaacaggctttgctggctgaagtcgttggcaatgtccggaaatgcgccgtagctcagcacgcatttatccgacagaccggtgccaatttgactccatgctttattgaactggccgatagccagcgcgtccggaaccatcacgttgttaatgaagtcggcggtgcgggtgatgatcgactgcaccaggttgaggcgctccatattgatagccccgaccgcgccgctttgatcgagattgatcgcgcacggcatcccgccgacgatccagttaggatgggggttcttaccgccaaatatggtatggattttgacgatctcgcgctggaagtcgagggcttcaagatagtgggcaaaacccatcagattagcctctggcgacagtttgtactgtggatgtccccaatagccgttacggaatatcccaagctggccgccatcgacaaatttcttcaatcgattttgtacgtcaaagaagtagcccggcgatgacatcggccaggcggaaaggctttgcgccagctgcgaggtggcgcgtggatcggctttcagcgcattcagaacatcaatccagtccatgccggctaactgataaaaatggaccaaatgatcgtggcaccacaacgtagccagcatgatgttacgtataatattggcgttatccggtacctggataccaatcgcatcttcgatagcgtacaccgacgccagagcatgtaccccggtacagacaccacaaatacgttcaacaaacgcccaggcgtcacgtgggtcacggccttgcagaatgatctccagcccgcggaacatcgtgccgcaggaaacggcattggtaatgacgttttgctcatcaatgttcacttcgcagcgcatatgcccttcgatgcgggtaatcgggtccacgatcagacgacggccggcgtcgttaacggtataaccctgggtttgatactggttactcatgcctgtttatcctcattgtccggctgttgttcggcttgcgctaactgttgtttgtggcgtttacgttggttgagcgcgctggcgacagcgtgaccgccaacgcccgcagcgaccacgcccagcgcggtcagccccaccgtatcggcggttgaatgggtacccatctggggaatatccaccacgcggctataaaacgagccgcgatcccagaaaccattttctgaacatcccagacatccgtgaccggactggataggaaaggagacgccgtcattccagcgtgtggaggagcaggcgttataggtggttggccctttacagcccatcttgtacaggcagtatcccttgcgggcggcgtcatcatcccagctctcgacaaattcaccggcatcaaaatgggcgcgacggtagcatttatcgtggatacgctgaccatagaacatcagtggacggcccatgcgatcgagttccggcagacgatcaaacgtcaccatataggtgataatggcgctcatgacatccgggattggtggacatccagggactttcacgatcggcttgtcggtgatcactttatcgataggcgttgcctgggtcggattggggcgggcggcctagacgcaaccccaggaggcgcagtttccccaggcgataatagcgctggcgcccgcggcggctttcttcagtttttcaataaacgggcggccgccgctgatacagaacattccttgctctcctaacggcggattgccttccaccgccagaatgtatttcccggcgtagcgagtggtaatatcgtcaaagacttcttcggcctgtgcgccggcggcggccatcagggtgtcgtcataatcgagggaaatcagcgagaggatcacatctttggctagcgggtgcgaggaacggataaaggattcggtacagcaggtgcattccagtccatgaatccagaccaccggaatccgcggtttattctccagcgcccaggcgatctttggcgtcattccggcgcccagtcccagcgatgtggcggcaaggctacagaatttgagaaagctgcgtcgggtcactcccttacgacgcatggcttgataaaaggtctcctcgttattcataacgcgtattttttctcctttttgcaccacgctccgccaggggcataaggcgcttttgcgggtccgttgacgttccgccagcaaggtaaatcattgtgttacgcgcgagcgcggaaacgagcccgattcactttgcaccgacgtataccgccagaaataatgtgaaaaaagcgtatcggattaacgataagaaacaatgtgaagtgtgtgggtatagcttatagcggtatatttatacccattatcggtttttcggcgaaagggccgtggcggggaagcgcggttgagtttgttccgggatgaggttttcagtgagcaacctcaagtggatttagcctggtctcgccatttcagggatacgtaagttgatgcaaaaggagggaggatttgatgtcatcgttaaaagaagcatacttcgtgatgatttttatataaaatgatggtgctggttttaaaggaatgcaaaaaagagactgtttgaaagagggcgtcccatgaaaaataacatcagatttgacttatccgattatttgattcatttttttcgggacgttgatttagagaccggtagccatatttatttacctgaacactgtggttttaataatcagcaccatgcatgttccattgatgctaaatatttacttagattatctttacgcagtcataaaattttctcgtcctggtcataccgaaatggacaacgaaccgtatatggtgactccccggtggtatgctttacagatatgccgattgcagcttatttagaaactggtgttcgccgattagaacgaaatgaaaatattggtttatatgcaatcgttttacctaaagagcaaatgtttaattatggggcaaggccagtcatatatgggttggatcagcataacaatgctcgatgctcgcaaggcagatatggggaacgtattcttgatgaaacggctcttcctctgattgaacaatatagatatgttacttatgttccaggtaagattgactggacacatgaacgcgaatggcgatggccatatcgtggcgatattaaaaaattccttaatcatattaaagagtatggtattccggaaaacattgaaagtaccccagggtttgattttagatcaagcgaaataagtggtgcgggaataatcgtcccgtttgcagaagatatccctaccgtagctcacgatattttaactttaattgaccggggtgtcattggaagaaatactttcaaattcattatagctgtagagagtttacaatcatggacccagctctcggaaccgggtgcgttactatcctatattaatgacaatactttcgaatttgaatctttttttgatttatctgcatctaaagtaaaaaattatgctgactctatcaatgattatgtaagtgaattatattcaaaaaaagattttttaaatgataattatgcaatggaatttggaaatgcctgggtctggattcatgataaccaatcccaggtggtacgggcgttactgcaggctggaatgatcaaggttaataaagaagggcggtacttattagatgttaatttggcttctgttgattggccattaagaagaaaagaggctttcgcaagtcatgttgcgggatggctcaaacatcgttttgatatcgaagcgggaaggtattccgttcggggaaaagatgattatgatgcgatcccaagttatgagacgccgctaaaggatcagcatcctttttataatcatacagtgaatgtcgactggtaattaagaaaaaaacttaccctgttagctctgcgttaattgagcctgtcagtatgagttgagatattatgaaataaaaaatccacgcggctgcgtggattttatgagtttctttgcctcttatgagattcagcaaaacctcataagacaacaatttttacttagacgttgaacaggaagttcattatatcgccatctttaacgatataatctttgccttccgctcgcatcttaccggcttctttcgcgccttgttcacctttataggtaataaagtcgtcaaaggcgatagtttgagcgcggataaagcctttttcgaagtcggtatggattttacctgctgcttgcggcgcggttgcgccaaccggaatggtccatgcgcgaacttctttcaccccggcggtgaagtaggtctggaggttcagcaggcgataaccagcgcgaataacgcggttcagccccggttcttccagacccagttcagccataaattcgtcacgctcgtcatcatccagctcagcaatatcagcttcgacggcggcacacaccggaaccacgaccgaaccttctttcgcggcgatttcgcgaacctggtccagatacgggttattttcaaaaccgtcttcattgacgttagcgatatacattgtcggcttcagcgtcaggaagcttaaataacggatagccgctttatcttcgtccgtcaggtccagcgaacgcagcatccccgcttcggccaggtgcggcaggcatttttccagcgcggccagttccgctttggcgtctttatcgccgcctttggctttcttctgtacgcgatggatcgcgcgctcgcaggtatcgaggtcagccagcgccagctcggtattgataacatcaatatcttctgccggatttactttacccgccacgtggatgatattgtcgttctcaaagcagcgaaccacgtgaccgatagcttcggtttcacggatattggtcaggaactggttacccaacccttcgcctttggatgcgccttttaccagaccggcgatatccacgaactccatcgtggttggtagaatgcgttgcggtttaacaatctcagccaactggtccagacgcggatcgggcatcggcacgacaccggtattcggttcgatagtgcagaacggaaagtttgccgcttcaataccggcttttgtcagcgcgttgaacagggtggatttcccgacgttgggcagaccgacgataccgcatttgaatcccatgatttaactcaccttaatatcttaataatcaacctgttatagaaaacagattgcagaaatggaaataacttcgcctattatacacggcgtgcggcaaaaatgccgcacatcactggttattgcgccttaaaggtatgcaaacggcttgttgctttggccagaccctctttgaaccacaattccgtacagcgcgccgcttcgtcaatggcctcatcaattaatttttgttcagaaacagggggtttacccagcacgaaaccaacaactttatttttatcgcctggatgaccaattccaacgcgtaagcggtgaaagttgggattattgcccagcttgctgatgatgtctttcagaccattgtggccgccgtggccgccgccaagtttaaatttcgcgacgcccggcgggagatccagctcgtcgtgagcgaccagaatttcgtccggctgaatacggtaaaaactggccattgcgccaactgctttaccactgaggttcatgaacgtggtgggtaccagcaggcgaacatcttccccttccagcgtgatgcgtgaggtatagccaaagaatttaggctcttcacgcaacggcgcgcgcaggcgctccgccagtaaatcgacgtaccatgcgcctgcattgtgtcgcgtcgcggcatattccgcgccgggattcgccagaccaacaatcaatttaattgccacgttttttgtcctgagtagatccatgactggcgcgtagtttactgtctgtctgcccgcttgacaaaacacagcgacactctgaagtaaattaaataattgccagcattgattattaaaaatgtaaactgttcagagtgttatttgtaaagttttgttaaatgaaactttacatttgtgatcgcacccgcacttacaaatggaagtgttgtctatactttacacataaagtttagggggatttcctaaaaacaacccaaaagttccggaggtgacatatgaaacgcaaaaacgcttcgttattcggtaacgtgctgatggggttggggctggtcgtgatggttgtcggcgtgggttactctattttaaaccaactgccgcagtttaatttgccgcaattttttgcgcatggcgcaatactgagcatttttgtcggtgcagttctttggctggcgggggctcgtgtaggggggcatgagcaggtgagcgacaaatattagtgggtacgtcactatgacaaacgttgccgccgtagcgacaatcgtcgtcatagctaaccggttcaggcccggtaagcgttatcgccaccgggcattgtccattaactgagtaaatccgctaacgcctccgtcctgttcgggaagaaggtcagacgtccaggaatgggtttgataccggcacgcgccattgtgcgcagcggttggaactccaggttactgatacgcaattcgcaaccctccggcagacgcttcacaaaacgctgaaaagcatcaagcccgcctgcatccagcactggtactgcgtcccatttcagaacgacgatacgtttgcccttaatacgtgactcaaggtcggtaaacagcccttccgccgcggcgaaaaagagcggaccgataacacgcagcaccagcacatcttcaggcacatcgacattgaccggcgcaagtcgagtcattcgcgcaatacggcgcataaacagcagggaagcaaggacaatccccacgctgatggcgatgaccatatcaaacagaaccgttaatgacatgcacagcagcataacgataatgtcatctttcggcgcatggcgtaacagatccaccactttatgggcttcactcatattccatgccaccatcagcagtagcgccgccatcgcggaaagcggcagccaggagagtagcggggctaagaccagtagcgccagaatgaccagaatagcgtgaattaccgccgagacgggagaggtcgcgccagcgcggacgttggcggcagagcgggcaatcgcggcggtggcggtgatgccgccaaagaacggcgcgaccatattccccagcccctggccgataagttcgctgttagctttatgtttggtgccggtcatgccgtccagcacgacggcgcagagcaatgattcgattgcccccagcattgccatcgagaaagccgctggcagcagcgcgcgcagtgaatcccagcttagcgtaaaatcggagccaggaaggctccacggcagcatcagttgcggcaggagctgcgggatgccgttgccctgagtgccgtcagccagaacgtaatggaactgtgagccgatagtcgccacattgccgcccagcagattaacaatccccattacggcgcaaccggccagcagcgcgggaaggtgtcccggcagacgaataccgagacgcggccagaaaatcagcgttcccagcgttaccacgccaatggcggcatcgccaatattgacggtgggcaacgccataaacagcgcgccgactttctgcaaatagtgctctggcacatgggccatctgcagaccaagaaaatctttaatctgcatggtaccgatggtaataccaatccctgaggtaaaacccaacgtgaccgacaccgggatatattcaatcaatcgccccagtctcgccaggccgaaaaggatcaggaagaagcccgacatcagcgtggcgaccagtaggcccgccagaccaaactgttgcgacaccggatacaaaatcaccacaaacgcggcggtagggccggaaacgctaaagcgcgagccgccggttagcgcgatcacgatcccggcgacagcggaggtatagaggccatactgcggcgcaacgccactgccaattgccagcgccatcgccagcgggatagcaataatcccgacggtgatcccggctatcacatcacgggtgaaccgggaggcggtatatttttctttccagcaagcatcgatgagagcgcggaaaggcatcacatgtgaggaaaataatttgttcacaataatgtttcatccatgagcgcatcatctgtcaactaaatggcaggtgaaggaggcataagtcatataaaagggtgttacagacaaaaaaacccgccgcagcgggtttcagatccgggttcgatcaatgctcgaacatggcggaaatcgattcttcgttgctgatacggcgaatcgcttcggccagcatacctgacagggtcaaagtacgcacgttcggcagcgctttgatttcgtcggtcagcggaatggtgtcacagacaacgacttcgtcaataacggagttgcgcaggttgtttgccgcattgcctgagaagatcgggtgcgtcgcgtaggcaaacacgcgtttagcgccacgttctttcaatgcttctgctgctttgcacagagtaccgccggtatcgatcatatcatcaaccagcacgcagtcacggccagcgacgtcgccgatgatgtgcatcacctgagaaacgttcgcgcgcggacgacgtttatcaatgatagccatatcggtatcgttcagcagcttagcgatagcgcgggcacgaaccacgccgccaatatccggggaaaccacgattgggttatccagattcagttgcagcatatcttcgagcaggattgggctaccgaacacgttatcaaccggaacgtcaaagaagccctggatctgttcagcatgcagatctacggtgagaacgcggtcaacgccgacgctggacaggaagtcagcgacaacttttgcggtaatcggcacacgggcggaacgtacgcgacggtcctgacgtgcatagccaaagtaggggataacggcggtgatacgacctgcggaagcacgacgcagggcatcaaccataacgaccaattccatcaggttgtcgttggttggggcacaagtggactggatgatgaaaatatcaccaccgcgtacattttcgttgatttgtacgctgacttcgccgtcgctaaagcgacctacggcggcgtcgccgagagaagtgtacaggcggttggcaatacgttgtgctagttccggggtggcgttaccagcaaaaagcttcatatcaggcacgagaagaacctcaggcatgcgtccattggtggaaagaatctgccgaaaactgtgcgggccaggcaaaatcctatccaggcggtgtattaaagagcgcgatgcaacgtctggaacaaggtgacgttgtcaccgaagctcagcttgcccggcttactcgtcttcattcacgtttcatgtgcgctggtatcaatgcctcacaccggtcaaatacggcatatatgaccggcgactcgtcatttcgccatcttcctgaaacccgaatgcgttagagtaactctcgatgcaatggggaaaggttaacacccttcgccacaaaagcattgagccattccggggcttgctcaagcacctggcgagcacaagactctgtatcgaattcagcaaagacacaggcccctgtcccagtcaggcgcgacggcgcgtattctaacagccaggaaagcgccgcatcaacctcgcgaaaacgttttcttgcgataacctcgcaatcattgctgaattcacattttagtaacgtatctattgacctttttggcgtattacgcggcaattgaggatctttaaagataactggcgtcggaatgcttacgccagggtgcgcgaccagataccatttttccggcggattcaccggcgttaatatttcgcctacgccttcggcaaacgcggcgtggccacgaacaaagaccgggacgtcggcgccgagcgtcaggccgagcgtcgccagttcatcaatggaaagcccgcattgccaaagatgattgagcgccaccagaacggtcgcggcgttagacgagccgccacccagaccgccgcccatgggaaggcgcttctcaatgctgatatccgcgccgcttccggcgggcaggcgtccactctccgaggcgactttcatcaacagccgcgcggcgcggacgatcagattgtcttcattttcaacgccggttaccggcgttaataaatggatttcgccatcgtgacgcggttcgatgtggagtgtgtcgccataatccagaaactgaaacagcgtctgcagcgtgtggtagccgtctgcacgctgtccggtgatatataaaaacagatttaattttgccggagaaggccaatgggtcatcatttcacaatccagttatccattttcagcttaatgcgctgactgccatctgaaagctccatattggctggcatggcaggctgcgttttgctgtcatagccaccgtaaaccactttccagtttttaccatcctggtggtagttcacttcgctcaggcggtactggtcgtccagtttgtagtcggtggcatcgccaggcagaccgaggatccactgccgcaggctgtttaacggaatcggcatcccggtgagtttgccgatcatctcttcggcgtcatcggcggtataacgctggcctttgttatccaccaactggacgttgcccggctgggcgttaagctccagctcggtgctgcccagcgggttggtaagcagcaggcggtagcgatcctgtccggtctgttgccagaagaagcgcgcatagactttctgatcatctgagatgtaagcaaaggcgccgcgcgtctggtattgattcagatgacgcacctcttgctgatgctggcgccactgaggggaatccgggctcttgcccgggcctttatgcccaggaagcgtacaggcggtgagaaccaggcttgctaacggcagtagacgaatcaggcgaaaatcgggcagggtcatagtgatgacgaatccttgtgatacggtgcaataattgcctgaaggcgttacgcttatcaggcctgaaaactgaaccggcaagctgtaaaaacgttcgcgccgcgattcggcaaatttttgctatcggttacagttatagcctttaatgctagcgccgcctggtgacatcgtctactttcaagttgtcttaaatcatcaaattagcgagcgctgccaattactccaaaagggggctctctcttttattgaccacgcgcatcctgtatgatgcaagcagactaaccatatcaacgctggtactactcccgcagacatgacccttttagcactcggtattaaccataaaacggcacctgtatcgctgcgagaacgcgtaacgttttcgccggacacgcttgatcaggcgctggacagcctgcttgcgcagccaatggtgcagggcggggtcgtgctgtcaacctgtaaccgtacagagctgtatttgagcgtggaagagcaggataacctgcaagaagcgctgatccgctggttatgcgattaccataacctgaacgaggacgatctgcgcaacagtctgtactggcatcaggacaatgacgccgtcagccacctgatgcgcgtcgccagcggtctggattcactggtgctgggcgaaccgcaaatcctcggtcaggtgaaaaaagcgtttgcggattcgcaaaaaggccaccttaacgccagcgcgctggagcgaatgtttcagaagtctttttccgtcgccaagcgagtgcggactgaaaccgatatcggcgccagcgccgtctccgtcgcgtttgccgcctgtacgctcgcccgccaaatctttgaatcgctctcgacggtcactgtactgttagttggcgcgggcgaaactattgaactggtggcgcgtcacctgcgcgagcataaagtacaaaagatgattatcgccaaccgaacccgcgagcgcgcgcaagccctggcggatgaggttggcgctgaggttatctcgctcagcgatatcgacgcccgcttgcaggatgccgatattatcatcagttcgaccgccagcccgctgccgattatcggtaaaggcatggtggagcgcgcattaaaaagccgtcgcaaccagccgatgctgctggtggatatcgccgtaccgcgcgacgttgagccggaagtcggcaaactggcgaacgcttatctttatagcgtcgatgatttacagagcatcatttcgcataatctggcgcagcgtcaggctgcggcggtggaagcggaaacgattgttgagcaggaagccagcgagtttatggcctggctacgcgcccagggggccagcgagaccattcgggaataccgtagtcagtcggagcagattcgtgacgaactgactaccaaagcgctgtcggcccttcaacagggcggtgatgcgcaagccatcttgcaggatctggcatggaaactgaccaaccgcctgattcatgcgccaacgaaatcacttcaacaggctgcccgtgacggggatgacgaacgcctgaatattctgcgcgacagcctcgggctggagtagcagcacacaccacacttttttacagggtgaatttacgcctatgaagccttctatcgttgccaaactggaagccctgcacgaacgccatgaggaagttcaggcgttgctgggcgatgcgggaattatcgccgaccaggaccgctttcgcgcattgtcgcgcgaatatgcgcaattaagcgacgtttctcgctgttttacggactggcaacaggttcaggacgatatcgagacggctcagatgatgctcgacgatcctgaaatgcgggaaatggcgcaggaagaactgcgcgaagcgaaagaaaaaagcgaacaactggagcaacagttacaggtactgctgctgccgaaagatccggacgatgaacgaaacgcgttccttgaggttcgcgccggcactggcggcgacgaagccgcgctgtttgccggcgatctgttccgcatgtacagccgttatgccgaagcgcgccgctggcgcgtggagatcatgagcatgagcgaaggcgagcatggcggttataaagagatcatcgccaaaatcagcggcgacggcgtgtatggccgactgaaatttgagtccggcggacaccgcgtacagcgtgttccggcgaccgagtcgcaggggcgtatccatacctccgcctgtaccgtcgccgtgatgccggagctgccggaagccgagctgccggatattaacccggcggatctgcgcattgatacgtttcgttcttccggcgcgggcggtcagcacgttaacaccaccgactccgctatccgtattacccacttgccgaccggcatcgtggtggaatgccaggacgagcgttcgcagcataaaaacaaagcgaaagcgctctcggtgctcggggcgcgcattcacgccgccgaaacggcaaaacgccagcaggccgaggcgtcaacgcgccgcaacctgcttggcagcggcgatcgcagcgatcgtaaccggacctataatttcccgcaggggcgcgtgaccgatcatcgtattaatctgacgttatatcgccttgatgaaacgatggaaggtaagctggatatgctgattgagccgattgttcaggaacaccaggctgacctgttagccgcgttgtccgagcaggaataatggattttcagcactggctacatgaggcggtaaaccagctccgggacagcgacagcccccggcgcgacgccgagatcctgcttgagtacgttacgggcaagaggcggacgtatatcatggcctttggcgaaacgccgcttaccgatgtccagcaacaacagctcgcggagctgctgcagcggcgtaaacagggcgaacccattgcgtacctgacgggcttacgcgaattttggtcgctgccgctcttcgtttctcccgccacgctaatcccgcgcccggataccgaatgtctggttgaacaggcgttggcgcgattgccggtcaaaacctgtcgtattctggatttaggcaccggaaccggcgcgattgcgctggcgctggcctgcgagcgaccggattgcgaggtgactgcggtcgatcgtatgcctgatgcggttgcgctggcgatacgcaacgcggaacatttggctatccggaatgtgcgtatactgcaaagttgttggttcagcgcactatcggggcagcagttcgacatgattgtcagcaatccgccctacattgacgcgcaggacccgcaccttagcgaaggcgatgtacgctttgaaccgcgctcagcgttggtggcggacgaaaacggtatggcggatcttacgcatattatcgataatgcccgccagatgttaacgcccggcggcttcctgctgctggaacacggttggcggcagggcgaagcggtaagagcggctttcaggcggtctggttacacggatgtagaaacgtgtcgtgattatggtggcaatgaacgcgtggcctgcgggcgttttacgccatgacaattgcaatgttgctcacgcttcatcttatttgtgttgcgctctccgtcagtttgtttgtcgctcgttactggtggcgctattgcggccatgcgttggccgccgcgcgctggacacgaatcgtgcctcccgtcatagataccctgttactgcttagcggtattgggttaatcgttaaaacgcacatcctgccattcacggagtcgggctcatggctgactgaaaaactgtttggcgttatcatctacatcgttttgggttttattgcgcttgattatcgtcaggcgcgcagccagcaggcgcgttttatcgctttcccgctggcgctggtggtgctgtacatcatcattaaactcgccaccacaaaaataccgttactggggtaagtcatgaggtcgttagctgatttcgaatttaacaatgcgccgctgtgtgatggcatgatcctggcatcagagatgattcgcctggattttcccacgcagtttgtctacgacgaactggaacgtctggtcagtctggcgcaggaagaaattagccagctcctgtctcaggatgagcaactggaaaaattgctggcacttttttacggcgagtgggggttcacggattcccgcggcgtctaccgtctttctgatgctttatggctcgataaagtcctgaaaaaacgccaggggagcgctgtatcgttgggcgctattttattatggatagcaaaccgtcttgatttgccgttggtgcccgttatcttcccaacgcagctgattttgcgtattgaatcgctggaaggagaaatgtggctgattaacccgttcaacggtgaaacgcttgatgaacataccctcgaagtctggttaaaaggcaatattagtccggtcgccgagttgtttaacgaagatttggacgaagcggataacgccgaagtgattcgtaagctactggatacgctgaaatcctcgctgatggaggaacggcaaatggagctggcgctgcgcgttagcgaagcattgttgcaatttaacccggaagatccttacgaaatccgtgaccgcgggttgatctacgcgcagcttgagtgtgaacacgttgcgctgactgatttaagctacttcgttgaacagtgtccggaagacccgatcagcgaaatgattcgtgcgcagatcaacaccattgcgcacaagcaaattgttctacattaattaaccgacattttacctataagtgtaaggcgatcctatgaaacaaaaagtggttaacattggcgacattaaggtggcaaatgacctgccgtttgtgctgtttggcggtatgaacgtgctggagtcacgcgatctggcaatgcgcatttgtgagcactacgtaaccgttacccagaagctgggtattccttacgtgttcaaggcctcttttgataaagccaaccgttcctctattcactcttaccgtgggccgggtctggaagaagggatgaaaatcttccaggaactcaaacagacatttggcgtaaaagtgatcactgacgtccatgaagccagccaggcgcagcctgtggctgatgtggttgacgtgattcagctcccggcgtttttggcgcgccagaccgacctggtggaagcgatggcgaaaaccggcgctgtgattaacgtgaaaaagccgcagtttgtaagcccgggtcagatgggcaatatcgtggataagttccatgagggcggtaacgataaggtgattctgtgcgatcgcggcgcgaacttcggttatgacaacctggtggtggatatgctgggctttagcgtgatgaaaaaggtctccggcaactcgccggtgattttcgacgttacccatgcgctgcaatgccgcgacccatttggcgctgcctcgggcggtcgtcgtggtcaggtgaccgagctggcgcgcgccggtatggctgtcggtctggcgggcctgttcctggagtcgcatccggacccggctaacgcgaagtgcgacggtccttccgcgctgccgctggcgaaactggagcagttcctgacccagataaaagcgattgatgatttggtgaaaagcttcgacgagctggataccgagaactgattgcggtttttagcttgtgtaggccggataagatactatccggcttttttgtctatggaaaacccccagctaggctgggggttccggaaagctttcagctttaagccagttattaaaaccccttttgatttgttaaaacatcttgcggtctggcgactgcaaaagttcaacaagaaatcaaaagggggtcccaatgggggacgaaaagagcttagcgcacacccgatggaactgtaaatatcacatagttttcgcgcccaaataccgaagacaagcgttctatggagagaagcgtagggcagtaggcagcatattaagaaaattgtgtgaatggaaaaacgtacgaattctggaagcggaatgttgtgcagatcatattcacatgcttctggagatcccgccgaagatgagtgtgtcgagtttcatgggatatctgaagggtaaaagtagtctgatgctttacgagcagtttggggatctaaaattcaaatacaggaacagggagttctggtgcagagggtactatgtcgatacggtgggtaagaatacggcgaagatacaggactacataaagcaccagcttgaagaggataaaatgggtgagcaattatcgatcccgtatccgggcagcccgtttacgggccgtaagtaacgaagtttgatgcaaatgtcagatcgtatgcgcctgttagggcgcggctggtaagagagccttacaggcgcatcagaaaaacctccggctatgccggaggatatttattattagtattcgaacggttatcaaaataatttatcaaaacgtcctcaattcagaccgcaatagtagtccatcctttaccccgatcgtcatgataacctgagaccccctgaaagctgatagttaccgattttgattgtggtggttttctttatgatgtgtggtttggctattttttgaaagtgccttaccagatttattgttattatcaggggattatttcaataaaaggtgatgatttattgcctgcaatagtgggtagattaagcattttatgaaattattagtgtctttatttgcacttctacaagactgttaagaggtgttgaaatatcagcctggtaaagaatacgtcagcgaaagtgaatgctatattagtcataaaaattcaggagacatatgctcaaacctatcttctacagtggaagtgtgaaggttccggaatgtctggaaacagataaggaaaaaaatgtcggacgtactcctctgtcttcagacattcagcaaattaaaaatgttgttgaagatattccgccatttccagaaagcagagcggtgggaggttctgtaagcgcagcgtacaggctttcttttgacgaagtgttttgcggtctcagcaatgaagagcgtaaaaaggtgtatggtcgcctttttggaaaacaagtacttgcgcatattcattccaggtgtcagcgcgacgctgacataataagagaaaaagcgctcaggcggataagccgtgagtgtggtaccgaaatagattgcgctctcttactaaataagatggtggatattttacaaaatgcccggctgacaataaattttaatgcagcaaaaattgactttgtctctctcttaaaaaataaagaatatctgaactcttatgcattaggttgcagaccaggagatttacctgcttataatgtcgggcgtgattcagttgaaactaaagcatttgaactggagaagcttgcagattcaccttatgccccatatggtcagacaggcggtttttccgtagcatatactcccaacagtaaaacttttagccctacaagcagaccaatttatgctgcactggactttctgaacggtgaaaatggaggtgccagcgcctatgggaaatcattttttgaattaaatgataatgtaaaaacaaattgtacattctcaccttttgatatctacggccacagatttggcctggatactagtaaattatctacattttgccatatggagaacctgattgcatcctgtcaaaatgatttttttggttataattgctttaagagtttggttaaaatggctaagggcgaaaaatttttagctcattctaattatggtacaggctatgaagggaattatatagaggctcatattcatggtgatgtatgtttattcagagatataaagcacgtttatttgtctttgcaagaaaactcttactcggaaagtcaactatatgattatgcaaaacaaataaaccaggcgcttaatagagactgcataatattatattgacaagcttattatcaggctctttaaaagagctttaaatgatcatgagcacatacttcttaaggtaggcagtaactgcttttatatttattatagcaggaccgctctggcagatacctgtgtggcacctcagtatggcctgaaaaatagaggaatatggaccagcagaagcgcctgctggctacttttcacttaaatcgctggaattcaccggcgctacagatgaagcgaccttaacagtcatcaggtgtcctgcattaccacaggagtgatttactggctatcgatattcctgctcatcaggtttttacgccatctacgcacatttattctgctataagttgaaatactgcaaaaaatattaaggcttattattttttctttaagcaaattttcgttcaacaaacttggatgcgggaatgtgtgaaatatcatttctttatactagaactcagcgacctacagctcacaactttattagatcctcttcctgaatatattacttttctggcagttatcaacaataggctgactaaattgccggacactttgcctggagggtacagacagattacgcgggtaggatcactacaccgggaaaagattgccagttaatgggatgtcgtccatgtttcagttggaggataatgatttatttccccctctttgaccctacaatagtgatctgatagttatcctgaacgttcttacagagggcgggcttgttaaataatcatcaagttattaatgagttatgtcctgctttgctgaaaataaaaatcagtagacagacgacggcgaacaatatgagccggaagtgcctgtgttattactgtggcgtgaattctgtaactgataaagtaggtgtgcttattatcagtaatgaaattttttatatatgtattattactattcacaggtaatttgattgtttgttgtgagtaacattgtgttgaagtaaaccatgatagactggactgtgatgtggtgagatataatgaatttgtgttttattaattattttaaacgtacaggagagtagtatgtatatgagtaagtatgtacctgtttatacattattaattctcatttattcttttaatgccagcgctgagtggacaggagataatacgaacgcctactactcagacgaagttatcagtgaattacatgttggtcagatagatactagtccttatttttgcataaaaacggttaaagctaacggtagcggtacaccagttgttgcatgtgcggtatcaaagcagagcatatgggcgccctcctttaaagaacttcttgatcaggcaagatatttttacagtacagggcaatccgtaaggattcatgttcaaaaaaatatctggacctatccgctttttgttaataccttttcagcaaatgctcttgtgggactatcatcgtgcagtgcgacacaatgctttggacccaagtaagaggggagaagaaataatgaaaaagttaatattcttaaccttatctatagttagctttaataactatgctgtagattttgtgtatcgtgtggactcaaccccgccggacgttatttttcgcgatgggttttcactacttgggtataaccgtaactttcagcaatttattagtggaaggtcatgtagtggtggaagtagtgacagtcgctatattgcaacaacctcaagtgttaatcaaacatatgctatagccagagcgtactattctcgctcaacattcaaaggtaatttatacagatatcagattcgtgcagataataatttctacagcttgctcccatccatcacctatctggaaacgcaaggtggtcactttaatgcttatgaaaaaacgatgatgcgattgcaaagagagtatgtttccacattatctattttacccgagaatattcaaaaggccgtggcgctagtttatgatagcgcaaccggtctagtaaaggatggtgtaagcacaatgaatgccagttatttaggtttaagcactacgtctaatcctggtgtgataccttttcttccggaaccgcagacgtatacccaacaacgaattgatgcattcggcccattaataagttcatgcttttcaataggtagcgtatgtcattcacatcgagggcaaagagctgacgtatacaacatgtctttttatgatgcaagacctgtaatagaacttatactttctaaataaatgaaacttacctatgttgcctattaaattaaacagcccgtttattagttgcctggttaatattgtttattaagttggctatccacttaaatataaatgtttatatacttcgataagttttttatcagattcattgcattaccaatcatagcattcaggtacgtattttattaatattagaaggagtcattatgactaaagatgaaatctttgcagctatccttagtagagaaggcggttacgttgatcaccctgacgacaggggggggccaacgcattggggtataaccctgacgacggcccgggctaatggctatatgggggatatgcggaatcttacccgtaatcaagcattaaaaatccttgaggcagattattggtatggtccacgacttgatcaggttgccattatctctcactctattgcagctgagctttgtgatactggtgtgaacatgggaccctcaatcccgattaagtacttccagcgttggcttaatgtttttaatgatcagcaaaaaatttatccggatttgatagcagatggtcagattgggccacggacgctttcggcactaacattttttctctctcaccggagagatgagggcgaaatgatacttatccgggcattgaattgtagtcagggacaacgctatctggagttagctgaaaagcgccaggcgaatgaatcatttgtttatggatggataaaggaacgggtaagattgtaattcccttacttaccactatagcggtttgtgatgatagcatataatgatatattcacacagagaactggtgaaagccactaagtctcattattactatattaaggcgtcaggtttttctatagttctttgtgtgttaaaaacgagaaattaattatgttgtatggtatgagaatgatagtatttccagccaaatattcttacggctaaatacattattatccttttccattttggcacgcccagaactttcatcccatccaggaatatgagatcggactcttttctgttacgtaatggataatgatacaggtagtcatgaatgattgccgctttggcatattcaccatccggtggcaataatgaccagaaaatacgcggaacagtggcaaggtcggtaacgaatcctaccggtacttcaatgacatcatttttatcttcactgagataaaacctgaatggctcataaacacgccatttataatgacctaacatttccataattgctggactggtaaaacaactcataattttaccttataataaatatatattctgcaccttacgctcaaagtacatgtcgtaaactctatttactcattaacagcttcgtgccaaaaaggctacgggataatgatcagaagcgagttgtggattacgtaatgcttcaaccctttgtgaataaggtgctcgatcgacaatgaccccataatctaaaataccaccgccaatttgcgtgggttctgtaggtgcgagtacggctacaactcgttccagatgctcagtcatcaggtcattttcaagtctgtctgggctgcgattaaaatccccggcaagaaaccaggataaatgccgcatctgaggttgtctaaaaaaattaatggtaaccctgacaatagctgcagcatccggacctccactagccagtgcgtgcgctgtcagaaaaacatcattacccagtccgatgccaatgacggggcgagatgcgacagttgtcggacgcaagacataaacattatccgctctttgtctggaaactattgccagattaacacggcgtgctccaacatcaatagccgagtggtagatatatcttatatcctgacggctggtggttccgagattccaggtgtattcatcaatgggaatacccactccaaaaggctgaatatgtcgtccggtaggaaccgctgaggtgggaacagcaccggcctcctgtaccataagaatatccacaccggcagtaccacttaaaagctgtctgacattgacattccatttactttctgtagatgctgaagagccctgaagattccaggtcataactttgtagtcactgatattagcgcaggcaaaagaaatatagctgcagatgatcatggtcagaaggaaaaaaacaggttttttcataatatctactctcccgagcattacttctttatctgaatgatatatgtgttaataacccattgtttcatgacgttgattttattctggcaatgcctgacttgtttctggttctatgtcttgtgtaggtagtaagatacatagtctaacgtcaataaaactaaaatggatgtctattacagaggtaaaatgaagtttattcagtacaatcaattaattattgttaataccaaagagacaactatgaataaacaactaactgaatttaaaactccattcgcttaactcattgtaactgtattgggttgatttatttgcggaaagagagattcgatatcattggtactttataagtaaacataaatttttcattaccaggattattatatccctgtgagggaggtgacatttcatctattctcactcttgtagtgacatagtaaatttggccacctgattaaaggcgatgttctcacctcaacacaaaacaggtaacttagtgaacaagaaaaccaaacaaatcaatggttacatcttgaacggctacaatagcgtcagacctcatcattataacggtgcactgacgccggaagagtctgagaacaggtaccgtttttactgtaaaaccgtgaccaatagcgtcgatgcgcaacaaaacgtataatccgttgatagggcgtacaggtgtggcactgggcaaaacgttcagtgacaatgactggagctggcggcatttggcaaatagcatgttgaccacgctataaacgccaacttccgctacatgttctgagtggtggcgtttgcgttatatcgtcacagacagcgcctcagggcgctgttttcgatcggacatgtcgctttcgcaggaggggacgttattcggcgaccagccacatatcagcctcttcaaacatctcttccagcatacggtgcagccgttctttctcggtttttgtacagtcactgtttaatgcgttcgcctgcattggcttaactttcacttgcgcatcgggaaaaagttgatgtacgcgttttgtgagttcattgaggatgatttcgcgtgcgcttggcaaaccttcaacatttcgcttgtcataaacgagttcgacgaacatcgctatttcctttttactggttggatgaccagtatttaagctgggtatataaccggtgtcaaggtttagccgccgttttgtcatcctaacgttgcggatgtaaagtaaattgatcgcacatggaagtaaaggtcgctaacctgttgtcatgtcaagaggttagcggctctctcttcacagcggtgtcctgctacctgatggtaaattccagggcgcgactaaaatcgcaatcggctaacacaacagggtcgccttttctgacaataatgctatttgtgcccaggcattttcggctctgtttccccttaattttgttatcatcagtgagccagcgctggttatcattacccgtgcatgaataaagaatgattggcgtgccttctttcgtaccctgtcctgcagcatccagacatttctcaccctgcgtgattctgtctcggtgaaatgagaaaagctgagattgcacatgtttacactcccgcagcgtcaaacgattctgttgatctgggcctgtatcaaggcacagaccatcagttgtccgaatttgttccgcgtcatttatgtaataaccaccggaattaatttggttttgtgtaatgaccgggaacgacaaattaatactataaggtgcgggtaagccgttcgtcgtacatccacataaaatagaggagaggcagagaaccagtgtgttttttcctgaaagcaaagtcattcaattattaccctaaaaataaatagcattacaactatattggcaatttatacccactgaatatgacgtagcattgagcggcaataaagataattccgatagaatcacataaatacttcggttaaatgcgcgcagccagccactcctgcgacgatgggtatatagcgttaaatacttttgcaatattacatgctatcacagtgaaaaacggctgtacatttcttcacgttaaacaaagtgagaaggggggttgacacccgatatatgataaaagaggtcacaggagtcattagcaaaataaatcttttagattttcgccactgaaaacattctgcagcctttcaggcaaagcctcatagcagactgcggaggtatacgtactcgctaaatttttctgaaaaaatgccgggtgacgaattatgaaagataaacgttggcggcggtaggtccgcggagtccattaatacgacaaaactcaacgcgtataccggggataagagcttctgtttcgtgttggcgacatgctgaaatgtggacctgaacatctttgcgtccatcggagggggtgatgagacctttaccgctcttacaatcaaaggttttgacaattcctgtcattttacgagacaaacaaattccttaatggggataacgaggcgcactatacacgtcaggaaaaataatgccagctatatttgatggcaatcaagatttccggatggctaaaagtagtcgttcggcaccattgtagataaataacattatgttctggagaaagtattccctttcctggcgtcgttggttggtgcggacatcatgggttttgccgtcgggcaggatggtgaactaatctgcctggcttgctttttatcggtatttgtaggtggttgcggggttttactaccaaaatcgtagataaaaatttcccatgatgcctgttgtaaaccagaacaatggtctgaactggccaaaacatggaatgaaaaaataagtaatgaccaaagcataaaagcatgatgtttcatagcacctcctgttatatgtaatgacttgcgaagttcatctaattaattatgggacgtcattggcattttttattcaacgaagagttaaccactcttaataataatgggttttatagcaaaatagacttttttatcgagtgttcaatatttgcgtccgttattatttttctggaatgtaaattctctctcaacacaggtgaaatttatgtttgaattgtggtgttgattctattcttataacaagaaatgttgtaactgatagacatattaaaagattgaatcggagcgggaataaagcatgctgaacatcatggtgaataggattacggtgccagcgatggcatgtaacggcatttcgtctggagcgtcacgtgaggactgtgaagcacaatgcgatatgttctggttatatggcgagtttgcttaatgacatttttttagccgatcagcgtcaggcttcttaatgtggttgtgatatttttctttaaatatcaaaagtttgtatgacgtgtttgttgttttatagtggctaaacactttatggtttctgttaaatatatatgcgtgagaaaaattagcattcaaatctataaaagtgagatgacattgtagaaccggttaccttaatgagcgatagagcgcttcggtagtaaaaatatctttcaggaagtaaacgcatcaggagcgatagcggtgaattattcgtggtttgtcgattcggcatagtggcgataactgaatgccggatcggtactgcaggtgtttaaacacaccgtaaataataagtagtattaaggagttgttatgaaaaatattattttatccactttagttattactacaagcgttttggttgtaaatgttgcacaggccgatactaacgccttttccgtggggtatgcacaaagtaaagttcaggatttcaaaaatatccgaggggtaaatgtgaaataccgttatgaggatgactctccggtaagttttatttcctcgctaagttacttatatggagacagccaggattccgggtctattgagtctgaaggtatccattaccatgacaagtttgaggtgaaatatggttctttaatggttgggccagcctatcgattgtctgacaatttttcgttatacgcgctggcaggtgtcggcacggtaaaggcgacatttaaagaacatgccactcaggatggcgattctttttctaacaaaatttcctcaaggaaaacgggatttgcctggggcgcgggtgtacagatgaatccgctggagaatatcgtcgtcgatgttgggtatgaaggaagcaacatctcctctacaaaaataaacggcttcaacgtcggaattggataccgtttctgaaaagcataagctatgcggaaggttcgccttccgcaccgccagttacaaaacagggcttctttaccagtaacacgtacctgcctgtcttttctctcttcgtcatactctcttcgtcatagtgacgctgtacataatatctcaccagcataagcacagataaaggattgtggtaagcaatcaaggttgctcaggtaggtgataagcaggaaggaaaatctggtgtaaataacgctagatctcacaggattcactctgaaaaattttcctggaattaatcacaatgtcatcaagattttgtgatcgccttcgcatattgtacctgccgttgaacgactactaaaaagtagcaaggtatgtattttatctaggagagcaccttttttgcgcctggcagaagtccccagccgccactagctcagctggatagagcatcaacctcctaagttgatggtgcgaggttcgaggcctcggtggcggtccaatgtggttatcgtataatgttattacctcagtgtcaggctgatgatgtgggttcgactcccactgaccacttcagttttgaataagtattgtcttgcaatcctgttacagaataatttcatttattacgtgacaagatagtcatttataaaaaatgcacaaaaatgttattgtcttttattacttgtgagttgtagatttttcttatgcggtgaatccccctttgcggcggggcgtccagtcaaatagttaatgttcctcgcgaaccatattgactgtggtatggtccaccgggaggcacccggcaccgcaattttttataaaatgaaattcacaccctatggttcagagctgtgtttttacatcaggtgggcaagcataatgcaggttaacttgaaagatacgagcaataacagaaaccagtgatttcgtttatggcctggggatttaaccgcgccagagcgtatgcaagaccctggcgcggttggccggtgatcgttcaataatgcgaatatgaatggttaccagccgctgcgaattctacctgggtcacttaataaagcaaaacatttaaacactcaacaacgacaattcagacagttcgaacttttctttaaaaataggattaaccatgtttaaaagtggttactaattagccattatcctacggtagtgattcacatattctttaacgttacgttacaggaaggttgaagtggaaatgcctgatgagccttcaggcatttctgaaggttagttagctaaggaacagttactgagaacaggtttatcatcaccttccaccagtttagccgttttgcctttggtataaagtttgtaagtataatttttgtctatggcttcgtaatttgctccggaggccattttcattaaccgcatcgggatcatctcgtttacctgactgataatcgcataggcgtttccagcctcggtgttgacgtaaatcacctccataacctggttatcattacaggtgtatatagatttagaaatctcctgcgaagctgctatagaggtggtactggcgctaagcgcagcgagaaagagggtaaatgggatcaatttacgtttcatcattagtatcctttgtgtataaaattgtcgttaattccctgaagagcgggagataaagcggcatcaatacgatgaatgctgtagtattcctgtttactgacgaaaagtgcgccagaaaagcgtattataatttatccatcactgacatatgtgatgagtagacaaatcttaaaatcataaactatagactgcaaatcattatggcgcgatggaaaatgattgtcaccactgctcaatactatggcataaaaaccgaagaaaacggtactgttcactgtctcgtttcatacggtatctgtcagtgaaactatttcttcaaatgatggtctttttattatcgatcagataatggcatcaacaggggttatttaggagtatatgtgaaaaagtggcttataggagggatattgatcgcaagttttctgaccggttgtctgatgtggcacaacattgataaatggtttaataaagatatcgaagttttctacgccggagacgataactaaaactcctgtcagttggcaacgggtgtcatatcttcaggtatggcgcccggagcagccgggcgcaaattgtaggtgtataaaagtcatttcattaaaattttagcgacaacatggacagtcactaccgcgtgctaacggccctctgaagtcacaagatgaataagccagttttttgtttcagcggtgactgaaacatattttgctcctggtgggcttaccgccagttgctgaaaaagacaacgatgatgtaactgttgcagagactgacgaatacgacgaccgtgagttttatttttggcgaccatatttcctcccaaaaggccgcccgaaggcggcgctgggtttgataatggagaagggcgttggtcactgccataaccaacctgtatacactaatgtaattgataatcattatcaattgtggtgatgaagaaaaattgtaaagatgaagggacagcggaaatggcaatgaacgggatgagatttttcgttaaccacttaaattcgtgactaaaaaaagtcttttataggcttgaaaatgttttttccgtccctatgtagtcagtggacaagcaatgcttgccttgatgttgaacttttgaatagtgattcaggaggttaatgatggcactcagaaccttgtcagcacttcccgtgtttgctgattctcttttctctgaccgtttcaaccgtattgatagacttttcagtcaattaacaggagatacgccagtcgctgcgacgccagcttacgatctgcaaaagcgcgatgcgaataactatctgcttaccgtgagcgttcctggctggaaagaggaagagcttgaaattgaaacggttggcggcaacctgaatattacgggtaaacacactgaagagacggtagaggatcagacgcactggatttatcgtggtattcgtaaggcagatttccagttgagtttttctttgcctgaacatgctaaggtgaataatgcaaaactggaacagggcctcttgttggtagagatttaccaggaaatccctgaaagcgagaaaccgaaaaaaattgccatagaaagcaaaccaaaggcgattgaacataaatcataaaagcattaatggaggcccgtttagacgggccttcattgtctgtagcgaaaagtatcccgtcatgcttgtaggcacagatcgctaaatattatagccctgacctctatattatcccgtgccactgacctcgtcgccattggacggcggtaagttggaattatccgcgaggtcagtccaatttttgtccactctcgacattctgcctgttatgggcgcgatacctgaacataaattcgtatagcggttgatcgttttcaccgcgttgatgctatttctgctaacactactttcatacgtaaaaaagctgatgctttttaccttatttaatagaggcaggtatgaaattagcgctcgtcaatcgacaggtcattttaccggaaagcggaaccgagtccttccagtgccatgcctctacgcttgttcgcctaccgtgcggtacgctcgtggccgcatggttcgcggggttgtgcgaaggaagcgaagatacagccatctggctatctcgctatgaacataatatctggacaacaccgcagcgagtggcggcacgcgagggggaagcgcactggaatccggtgttattttacccgtcggataaattgtggttattttataaagtaggcagcggcgtacacgtgtggaaaacctggtttatcacctccagcgatcgaggatttacctggagtacgccagctccgttggttaacgatgatattttgccgcgcggtcccgtaaaaaataaactcctgctggcatcaaatggcgcctggattgcgccagggtcgattgaaagtcctgaacggtggagggcatttgtggatcgatcctctgacgaaggaaaacactggaatatctcttttgttccgctggagcctgataacgctatttccgggacaaacgtagcgttgtgggatggtgtaaaaaaggggatgttgtgggaatgttgtctggaaaacctcctgcgctgggatggcgttattcagcctacgctgtgggagtcttctccggggcatatccatatgttgttacgaagcacacgcggggcaatttttcgcagtgattcaatcgactatggcgctacctggtctgttgcccgcgcgacatttttaccgaataataatagtggtatcgatctggttagtatgcaggacggtacgctgattcttgcgttaaatccggtcaacggcaactggggaaagcgctatccgctttcactgattgcttcccaggataatggcgaatcatggctaccgctactggacctggaaagtgaccacggtgagtattcttatcccgctattattagcaagggcggcgtcgtacatatcacctacacgtggaaccggaaaaatatcgtatattgtcgattacaaacggtataaggcgctatcagtcgaaaccgatagcgctggaataataatgccttgcccggcgtgctctctcacgtcgggatggccgaaatagtcatgatttaccgggtaacatccttgaaaatgtatcgtctttttgtatgtaatggtgaaacaacgccgctgctgcatgcatggcaatcaggaaatagccgatattggccagcatttcatgaatacgctttatatccgattttagggtgctatctggcgtcaaaaataccggtacagtaaaaccaaaaaagctccagcttttcccgcctgatgccatcatcgcgacgcccagcagcggtaaggcgagaaaagtgagataaagcgcgatatgcattaatttagcggctacgtgctgccagtgaggagggggaggcgtaatgaccggatccgggtatttgtgtttaagatataaccgtaaaaacatcagcgcccagaccagaacgcccatgtcatagtgcatgtctttcataaataggtaaacgctggagccttttggcgcccacccccgtaactcaatagccgcatatgctatgcctgtcaggagcagtgttaaccagtgaagcgttatttgcagtcttgagaaatgtgccattattattatcctttattaacaactgcttgtagggtatgcgtaaaatcttaacagaaccttaaagcgggggctgagtcgcaaggaacagacagagatagcggcacgtaaaatgggataaaaagccggcggcatcgccggcttactgttgttattgtcctcttacgacaacacaggttttaccataaaacggatatgagcctgtagtttcataatcaacactcgacactaaagaaatatcgcccgcttttttcgctgaatcaatagatgcgtcgccggtatttacaatacccaataccgtttgcgcacacgctttaccggttttggttgccgggagactcgtggcagtaattggccctttaacatccgtatataagccaatccctgtcggtgatggtcctgtagcacaccccgttaaaagagaaccaataaagataattgaaaaaatgtgttttttatttgtcatgggattagtccattataaattaatagaaaacttaccgtccgaaaatgtccggacagtcatttaaaaagtggtgtatattaaatatgcgatattactctttgcaccctcctgttgatgtcgtacctgatggacaaatatccgttgaagccggatatattccccatgccgtgtttttataacttgcgcatcctgtcagcaatgagaacagtacggctaaaaaaatcatcacgagccctggcggcgttaacatttttcggttggactccatagcatgtcatttcatcgggttgccatatgactggcgttctgctggtaagtttcattaacgcctggttcgtttaatattggtttaggtttaaagccaggaagcgctaattacgataccttcttacgtttcagtactgactaataacgttgagaaaatgaacagcgtcggatgggaagacgtaatacagaatagaaaggaaataagagaataagatggcgttaattaacccggtattcctggcgtcatttcccttgcgttttatccccgtcaaaagtggcctttagcccacgttggcgctcccgacgttgacaaccagtgagtgtccatagtgtgcgtatgatgtttttaaaagatcgtcatactttctgttctgcatcaattttttcattacaaatgctcgccataatgccgtcctcaggaggtctcccgacgtttatgctgcgccgggagaaacaaaaacaacgcataatctgggacaaattgatgattaaaggcaaactggcgctcgtgacgtgcgcgctgactctggtattcacttcgtcgcttttcgccgcgtcggacacggcagatggtcgtaccctgaagctggccattggccctgagccaacggaaggctttgatcccatgctgggctggagccacggcagctacttattgcttcatgcgccgttgcttaagcaaaacgccgatatgagttggggtgatttactgacggaaaaagtggataccagccccgacggtaaaatctggacgctaaccttaaagcccgggctgaaattctccgatggctcgccattaactgccgaagatgtcgtttttacatacaataaagcggcgaagagcggcggtaaaattgacatgggcaattttagccatgcgcgagcgctggatgcgcgccgaattgagatgacgctgagccatccgcagagcacctttgtgaatgtactcgggtcgttagggattgttccggccagccgttatgatgaaaaaacgttcgcccgcgaaccgataggcgccggtccataccgactggtcagctttcagccgggtcagcaactgatcgttgaagctaatccctggtatgcgggtaaaaagaatgactttaaccggctggtttttgtctttctggatgaagataatgcttatgccgccgcgcgcagcggacagttgggactggtgcgcattgccccttctatggcggtgaccccgcagcaggataatcttaaactctgggtacgcgatagcgttgaaaaccggggcattgtcttcccgatggtgcctgccggtaaaaaggatgctaacggttatcctgtcggcaacgatgtgaccgctgatgtcgctatcagacgcgcaattaactatgccattaatcgtaagcaactggcggaacaggtgatggaaggccatgcgatacccgcctatagcgcggtgcagggattaccgtggcaaaatccttcagtggtattcagcgatggcgatattgcaaaagcgcgcgccatcctggaagaggctggctggaagataaacagtgcgggcgtgcgtgaaaaagcaggtaaagaagcgcgtctgaccttatggtatgccagtggcgacagcacccgacgggatctggccgaggcggtgcgcgccatgttgcagcgtttaggcattgtcgtctcgttgcaatcgggaagctgggaaactgtagagcgccatatgcacgctaaccctacgctgtttggctggggaagtctggacccgatggaactcttccatcactacagtgggaaagccgctggtgtggaatattataacccgggctattacagcaaccctgcggtagaagcacatctgaagcaggctatagatgcgcctgactggcaaaaggcgatccctttctggcagcaggttgagtgggatgggaagcagggcgcgggcgtccagggcgatgcggcatgggcatggctgcttaatattcagcatacttatctggccaacccctgtattgatctgggaaaaggctcgccagaaatccacggtagctggtcggtgttaaacaatcttgatgactggacctggacctgtcggtgatgaaattgttcttcagtcattttttgcggctgattattctgttggtgctggtggctgccggcaccttcattttgcttagcttttcgcccgttgatcctatccgtgcttatattggcaacgatctgctccatgttccgccagaacaatatgcgcggattgcggcgcgctgggggcttgaccagccgctgtgggagcgtttcggtcactggttttggcgtctgctccagggcgacatggggtattccatgctgttcaacatgcctgtcgccagcgtgatccgggaacgttttgcgacgtcattcgcgctgctggcaggcgcctggctattgtctggtgtgctgggcgtaacattgggttttctggccggacgttttctccaccgttggccggataagatgatttgccgtatcagctacttattgtcatcgttgcccactttctggatagcaatgctgttgctggcgctgtttgccgtccgctggccggtattacctgtttgttgcgcctgggaccccggaaataatgcaggaacagctcttttatcggaacgtttacgccatcttgtgttgccggtatgtgcgttaagtctgttgggcatggggcaaattgcgctgcatacgcgagaaaaaatagccagcgtaatgaagagcgaatttattcgttttgcgcgcgctcagggggataaaggatggtcgctgttacgtcaccaggtgttacgtcatgcgattaccccagcgctctgcttacagtttgcttctctgggtgaactgatggggggagcgttactggcagaaaaagtctttgcgtatccggggctgggacaggccactatcgatgccggcctgcgtggcgatgtcccgctactcatggggatcgttttattctgtacgctattagtgtttgccggaaatacgatttcagcctggcttgtggtggtgcttaatcgatcgctggagcgtcccgatgctctataatcctgccccgacgttgtttcgtctgctcctctccgttacctgtctgctgtttattgccggatacggttatgccacgttgagccagccgccagaggttaatctgcttgcccggcatctgtcgcctgatatccagcactggtttggcaccgataatctggggcgcgatgtatggcttcgttgctttcagggggccttcaccagtttacaaattggcgttggcgccgcgctgtgcagcggcgttatcgcgttagtgatggcggcagtggcgcgcattcatccccggctggacctcctggtgcggctgataaccgatgctatgctcgccatgccgcatttacttttgctgatccttatctgttttacgctcggcggcggtaaaagcggcgtcattgcggccgtggcgttaacgcactggccccgtctggcgctgattctgcgcgccgacgcggagcgggtagcgcagagtgactacctgacattgacctatcgtctggggcatggacacctttattgctggcgatatcactattttccggcgctattgccgcaatggttgacgggaacgttattgatgtttcctcatgcggtattgcacagcgcggcgttaagttttctggggtttgggctggcgccgcatgagccttcgctggggctgttgctggcggatgcgttacggtttattagccatggaaactggtggctggtgctatttcccggcctaatgttattcacgctggtgatgctcttcgatcagtttgcgcgcgccattcagcggctgtggctaaggagtgacgtatgctgagtttacaacgggttacgctggaaagcgcgcgttatcgctggtatggcgcgagacgctggtcgccgttattacagaatgtctcttttgatatcgcgcccggcgaaatggtggcattggttggcggcagcggggagggaaaaagtctgctgctgcaatgcctgctcgatctgctgccggaaaacttacgttttcggggtgagattacgcttgatggcaaccggctggacagacataccatcaggcagcttaggggcaatacgtttagctacgtgccgcagggggtacaggcgcttaatcctatgctgaatatcagaaaacatttgaacagagcatgtcatctgaccggacgcgcctgggatgagacgcagatggtacagttattacagcaaagcgatcttgcaccgacagtcctggaacgctttccccgccagctctccggtgggatggctaaacgaattctggcgtgccacgcctcgctcagccaggcacgttatatcctcgcggatgagatcaccgcctggcttgatacggcactggcaaaccagttgcttgagcacttgcgaggtctctgcgagcggggatgcggcgtgctgtgggtgactcatgacctgctgctggcggcgcggtatgccgatcgcattgtggcgctgcatcagggttatatcacggacaatattcgctgtgaacgattacagccggaagagatgagtgagccgttaaaacggcaatggcaggcattgcctgaactaaacccgttatttatgccgaccggagagggaatagaatgctgagctgccgcgacctcgttattcgtcagggcgggaaagtcttatggcagaacctgacgtttacgatttctgccggtgaacgggtaggaattcatgcgccaagcggaacggggaaaacaacgttggggcgcgtcctggccggatggcaaaagccgacgacgggcgacgttctgctggacggcagcccgttacccctgcatcagtattgcccggtacagctggtcccccagcatcctgaactgacgtttaatccctggcgaagcgccggagacgctgtgcgtgatgcctggcagcctgacccggaaacgttgagacgtttgtatgtgcagcccgagtggctgacgcgtcggccaatgcagctctcaggcggggagttggcgcgtattgcgatactacgcgcgcttgacccgcgagcgcgttttctgattgccgacgaaatgacggcgcaactcgatccgtctattcaaaaagcgatatgggtatacgtgcttgaggtgtgccgcagccgttcattagggatgttggtgattaatcatcagtctgcgctacttgatcaagtctgtacccgccatttacaggtggaatagccgcaagtcgtttctccgcattgtcgtgtcgccgttaacgcaccgggagcccatgggttcccggtattgtcggcagagattttactgcatgacgcgtttatctgcgttttttgcatcagcggtattactgtagtccctggtctcttcaacctgtacaggggctctgacgaccagacttggcagcgccagttcgatatcattctcaatgagtttttcaataatacggatatttatctcttgctgaatatccatgtatttattgtaatccgcggtattgacgatatgtaccacctcataggtcagccgatcctgaccaaaggccagtagatgggcgcggtcgaattgtgtttcgccgacatcggtaataatctttttcaccatatcgccgatgaggcgtaacttttccggcggtgtcgcagtggcaacgccaaaagtaaacacgatacgacgcgtttgcatccgcttatagttgtgtatggtttgctgcaacaactgcgcgttcgcacaaacgatctgttcgccgctgaggctacggatgcgagtggttttcaaaccgatatgttcaatcgtaccggctacatcattaaagacgacgaaatcgccgatctcgaagggcttatcgaaaccaatcgacagcgaagcgaagacatcgctcagaacggtttgtaccgccagggcaatagcaataccgcccacgccgaggctggctaccagtgcggtaatatccacgccgacgttcgccaggatggagagcaacatcatagaccagacgagcacgcgcaaaatcataccaagaatgactaacgtcaccgggtttttattggagcctggggcatacagtaaatgacgcatccatgactgtacgccctgatcaagccaaatcgccatttgaatcgcaaccactaaaaaccaggcgtgagagagggtagagaataaccggtcgggcagggcgacaaagcgcaggctaaagagaaatgcggcaaaaaagatgagcatcttactggtctttttcagcatctcgaaaacaataggccgcagccgcccatgagcatcatcctttttatccgggcgttgtagcgctttatagaccacattaagtagccagttgatgagccagtaagtaatgagggtgacgaaaaaaacgaccgccagattgatccagaacgtcgttgacatcagcatcgcaacgatatttagtcgtgctaaatactccattttacctccgatgaaaagcagatgaacattacagtatagacgtcacatcacggaggccgatttccggctttactattgctgttttattcagcacttttgttcaaaaagcatgaaaaagaggggtagccgtttggctatcccggcgtttctgtgcagacttatctactcctcttaataaaataaggagtcatttatgcaacaagaacatcgagagtgtattgagcagtgttatgaatgcgcggcggcgtgtgatatctgcgcctcttcttgtctgcgtgaagataacgtcgaaatgatgaagtattgcatcgagttagatatgcaatgtgcggccatttgtcgcctggcggcgcaatttatggcattggaaagcgagtactcacaaaaattatgccgcctgtgcgcggatatctgcaaagcctgcgccgaagagtgtgcaaggcacgatcacgaccattgccagaattgcgcgcgggcatgcagccaatgcgcagacgcctgccttaaaatggccgcgtaatttttcttccgccattagctcaaccggatagagcatagagcttctacctctaaggttcggggttcaattcctcgatggcggaccagttgatatcaaaaaaggccacctgcgcggtggccgctgagtttctgttgaaataaatgcaatgttataatataacaatcatctttctaagaaagatgagggtaacgttttggtgattcatttaaaaaaactgacaatgcttctgggaatgctgttggtcaatagtcctgccttcgcgcatggtcatcatgctcatggcgcgccgatgacggaggttgagcaaaaagcggcagcgggtgtgtttgatgacgctaatgtacgcgatcgcgcgctcaccgactgggatggtatgtggcaatccgtctatccttatctggtcagcggcgagctggaccctgtcttcagacaaaaggcgaagaaagacccggagaaaacgtttgaggatattaaagcgtattatcgcaaaggatacgcgacgaatgttgagactatcggtattgaaaatggcgttatagaattccatcgcgacaataacgttgcatcctgtaaatacaattatgccggctataaaattctgacttacgcatcgggtaaaaaaggggtgcgctacctgttcgaatgtaaagatgcgaatagcaaagcgcctaaatatgttcagtttagcgatcatatcattgccccgcgcaaatcggcgcacttccatatctttatgggaaatacctcgcaacaggcattgttgcaagagatggaaaactggcctacctattatctttatcagttaaaggcgaatgaggtcgttgacgaaatgctacatcattaagtctgattgcaatgttaaaagctcgctatgaatagcgagctttttttctgccgttatgccatatttctggcaatcaatataaaaaatacctgcgcccccggagcaacgatgacgctgtccataccgccctcgattcaatgccaaacggaagcggcgtgtcgcctgattactcgtgtcacaggcgatacgttgcgtgctattcatttatatggttccgctgtcgcgggcgatctgaagccaaacagcgacattgatctgctggtgacaatatgccagccgctgacggagacccaacgcgcaacgctgatgcaggaattgctggcgctttcatcgccgccgggggcgtcagcagaaaaacgcgctctggaggtcactgtcgtgctttattcgcagctggttccctggtgttttccaccttcccgggaaatgcaatttggcgagtggctaagagaggacatttatcaggggatttatgaaccagcgcagcaggactgggacatggtgttactgataacccaaattctggaaaccagtataccgctaaagggagaacgcgcggaacggctgttcacgccagcccctgcggcgcagttgctgaaggccttgcgttatcccctcgacctttggcaatccacggcagatgtgcagggagatgagtatcatatcgttttaaccctggcgcgtatctggtacaccctttctaccgggagatttacctctaaggatgcggcggctgactggctgttacctcagttgccagaagagtatgctgctacgttgcgtgcggcgcagcgtgaatatttaggtctggagcaacaggactggcatattttgctgcctgcggtcgtacgctttgtggattttgcgaaagcgtacatccccacgcagttcacataagatgccccaggacgtctgtcaggttgcgcaaacggcgttcctcaactactacttaataggttctcatcgctgaagtaagcagatgatcttatgcgggccatcgaatggatattcccacatggctctcgttttgttgaggtggatatgactggttccgcatcatctgttttaaagacagatacaagactattgagcgaaaacctgtttcttaattatggtctggagtccttatttaaggacgtcgcaataatagctggcaacgtaaattatattgtttttgatatcgacgattactacaccgtacagcagtatattacttccacatttaaaacggtactcattgggattgttacccataatgaatataactttattgatgaacatcatgctatatatcgaataaaggtcgatgcctctattgctgagtggcgcgaattactgattttggccgctgctggtcaattttttcccagatcagagaaagtcagattaacggcgaatgaaagaaatgttttggcgatgcttgttaaaggaatggatatccgacaaataagctgtgagctgaatgtacatttaaaaactatttactcagtacgctaccatgtcctgactaaattaggttgtagaacagttctggattatcaaatactgtccgtctctaaagcctttacgcactggcttacaataaataatgtcgataatgtaattttccgtgtaaatagcaaggtcattgcttaataatgatttgcttctgatggcgtttaggttcactatgctttcttacatcatcatgaggccagacaggcatggctacttttagtattagcgcaatggcggcgcagtgtggtgtcacaacagcaaatatcaggtcctgggaacgctatggcctgcttcaacctaccaaagatgaagctggcaatcgtttttattgcatagaagatgctatcagaatacagcatattatcgacgcgttaagcaaaggcttctcattaaaagagattaaacctgccctctatggtgaagaaacgcattgccgctcgggatggttattctaccaggaagagattttagcgcagtgtagaaaattcgaacccgccaaattgcgaaaattactctggcgttatggtcgggaaattccgccgtgtatcgtaattgagtcaatactgcgtcctttatggctgtggttgtccgcaggcgatgatgatgcacgccgatttgaaaaggcattactggatactgcgattattgaatacgccacgttccagctaagtagcgtacgaaaggcgccagcaggcacaatgcttattgctgcgttttcgctgaacgaccccattgagctatggctggaaacgattaaatattgtagtgaaggtatgcgagttgaagtcatcccctggcaggcgccgatgcccgatcttttatcaacgtctttcgagcatattgttttgtggcatgatgagacattaactcccgcccaggaaaatcttattcaggctttaaaagaatcgggtaaatttagtcttcatgtgaaaaatggctcaggcttaacattactgccagccgtataccggcagcatgagatgcccgaaagcatgcagcatgttgcaccgcaaatccatgcaaacggctacgaaaaatcaggcaccgcacgttgaggcatctgcattattaacgaacaggggaggagtaaccccctcccttgtttatacccttcatacttcaagttgcttatgtgttggctacggattactcggcccatccataggcctcgccctgacgggccgtcgcaagcgacgttcaaatctgctcccggcagatttgtcgctcaccccagtcacatagttatctatgctcctggggactcactcccttgccgccttttagcaacacgaattattttgggtatatattagatgtcgtcaggtgtctgaaaaaaaacggcttctaaggcattgcggtaaatatcaagctgcactacgtctttttctgtttccagtttttcaataagtttggcgatgatatccttatttgagacatgctgctgcgattgcaatagttcgtaagtaatttcctgaatagctcgctgttcacataacatatgtgcagaaaaaggattgccagtactattttgttcgttgactagtgtaatggtagtcatatttcaccatattcgatgtaaattgaagccgatctccctgagcgggggagagaaattagtgacctattaaagttagacctatatcataaaactgtaataaaaaatcataaaaacgtgatgtgcatcacatttgtgtgatttgttgtatattttatacactttaaatgaaggtgaagattccgcagaatcaacggcctgttcttttttctcactccagtttaaacgaataagcattaatacccatctgtaataattacttaatgttatcttaataaaggtaaattactgtcagacctccgtaaaaggaggttgattaatgattcgtcatatcgccatttttctttgttctttattgatgtgcagcaccacttttgccgattcggtaacgtcggtatcgcttggcgcgctcttaaccgcgctcaatgaacgcatgttattaatgaaagatgtggctgcttataaaatgaagcaccatctgccgatagaggatttcacacgtgaacaaaatgtttttgccgaggctgaagaagaagcgaaaaataacggtctggacccgcattcgataaccccttttattcgttcgctaatggatgccagtaaagcgatacagtaccgctatttagcgcagtggcgaaccggctcagaaccctcctttccgatacaaaccttgtcggtcacccggcaacgtattcgacaacttgataatcaaatgttgatcattatcagccagcgcctgatggtcggcgctttcagccatgaggatatggtgtggctgagaacgcactttaatgcgccgaatctgaatgagagcgatatcagtgatgtgttggcagccctatctttggtgcgacacgcgcgttaatcccccatgaggaaacgtgggccaatacctggtgattgcctgcgggggcgcgataaaagaacgtttttgggtgatggggatataagcgtggcggaatagcggctggagagacgtggtttcgcttcccatcttccgatgcattcgttagcatactgtttcgcagctaagcgtaaatgttttcaggaagaggttaatgtgttcgcggagtatggtgttctgaattattggacgtacctggtcggggcgatttttatcgttctggtaccagggccgaatacgctttttgtgcttaaaaatagcgtgggacgcggggttaaaggaggatatcttgccgcatgtggcgtgtttatcggtgatgcgatattaatgtttctggcgtatgcgggcgtggcgacgctgatcaaaacaacgccggttctgtttaacattgttcgctatctcggcgcgttttatctgctctaccttggcgcaaaaatcctttacgccactctgacctcaaaagggcgtgcggcgacggaaacggtagttccttttggcgctatttttaagcgtgctttaattcttagcctgacgaatcctaaagccatacttttttatgtttccttttttgtgcaatttattgatgttactgcgccgcatactggggtgtcattttttattttggccaccacccttgaaatcgtcagtttttgctatctgagctttttaattctttctggcgcttttgtaacccactatattggtaccaaaaagaaactggcaaaagtgggcaattcgttgattggccttcttttcgtcggatttgccgcccggctggcaacgctccagtcttaaccccctggacccgtcgtgaacggcgggtcattgctctcctttcggttttattgcgtggaaaacagcaaaatagtaaccaataaatggtatttaaaatgctgtttttggagcgtaacctttttacgacagcgatgagattatcgctgagtaacctgcgggaagagggaagcaaatgcggcaaattccacaaaatcatatccatacacgttccacgcccttctggaacaaagagacggcgcctgccggaattttcgaacgccaccttgataagggaacgcgacccggcgtttatcctcgcctctcggtgatgcagggggcggtcaaatatctcggatacgctgatgaacattgctctgagccggaagagatcatggtgatcaatgccggcgagtttggcgtgtttcctccggaaaagtggcacaatattgaggtcatgacggatgatacctattttaacatcgacttttttgtcgcgccggaagtactgatggaaggggcgacctcacgaaaagtcattcatgccgggagagaataataatgggaaaagctacttataccgtcacggtcacgaataatagcaacggcgtctctgtggactatgaaacggaagcaccgatgacgttgctggtacctgaagttacagcagaagttgtgaaggatttggtcaataccgtgcgttcctacgataccgaaaacgaacacgacgtttgcggttggtaaagatgctgtagtatctatttgatataaaatgattctttaaatgagaagccgcatcgcgcgtcgccagcgtgatgcggtttttgcgtattgaaaagcgctgtttatttacatcagacatgggttgaaaagaaacattaagaaaacattaagaatatcgcattgtttgctaatgagagcgtattcataaaacttatgattgggtattaaaaaccagaagagtcttatgatcatgaaactcgatacccgattaacttcgtcagcacttactcttgcgcttgccgctgtggtcatcccgtttacggcggactggcaattgcctttgcttaacggcgtggtggtccgatggattgaaaacggacaagcgttatggttactgtttggggcgctatttaccgcctggtatatacggccactttcccgtcccgaaggggcaaagcagttttggctatgggctgttgtctggtgggtggtgctgttgggtagaagcaccagttgggggcgtgactatttccctgacgagccgcgtatgctgttcagaacgatttcagtgctattaattgctgcgttggtattgccagtcctgttttttgccgggctacgtaaggagattgttcgtcgtctgcgggacgttcctctgccattgtggctgtttaccgtgacggcatgttcatatctgatttccgacactgtcgagcatcatcggtggttgtcgccgatattcctgcataacgctcgttacacagatttgattgaagagctttatgaagtgccatttatgatcggtttgtttatggtgaccgtggggtttatgcagcaggacaagcaggatgaatgtactgcgctggagctgaccccgtatcacgcaaaatagcgcggctgaaaaagaccatgaattcgatatgggatagatagcagttagcaaaaaaagcccgcactcggtgaggcgggcaaataatactggaagcaatgtgagcaatgtcgtaccgaacaggtgggttataaactcaaccactcggtattgataaagataatcgttatcattaatgattgcaaccctgatatttatgcgcttttatccacgacgctaaaaggtgatggatatcacaaacttcactttcctgacgatgtgctattctttttaacggcaaataaaccgctaacgttaagacataagtgaggaaaaaatgggtattctttcatggattatttttggacttattgcgggtattttggctaagtggatcatgccaggtaaagatggcggcggattctttatgacgatcattctggggatcgtcggtgcggtagtcggaggatggatcagtacgttctttggctttggcaaagtggatggtttcaacttcggcagctttgcagtcgcggtgatcggcgcgattgttgtgctgttaatctacagaaaaatcaaaagctaaacgcagaactttcagagataataaaggctacgacaggtagcctttattattgtctatggaaaacccccagctaggctgggggttccggaaagctttcagctttaagccagttattaaaaccccttttgatttgttaaaacatcttgcggtctggcaactgcaaaagttcaacaagaaatcaaaagggggtcccaatgggggacgaaaagagcttagcgcacacccgatggaactgtaaatatcacatagttttcgcgcccaaataccgaagacaagcgttctatggagagaagcgtagggcagtaggcagcatattaagaaaattgtgtgaatggaaaaacgtacgaattctggaagcagaatgttgtgcagatcatattcacatgcttctggagatcccgccgaagatgagtgtgtcgagtttcatgggatatctgaagggtaaaagtagtctgatgctttacgagcagtttggggatctaaaattcaaatacaggaacagggagttctggtgcagagggtactatgtcgatacggtgggtaagaatacggcgaagatacaggactacataaagcaccagcttgaagaggataaaatgggtgagcaattatcgatcccgtatccgggcagcccgtttacgggccgtaagtaacgaagtttgatgcaaatgtcagatcgtatgcgcctgttagggcgcggctggtaagagagccttacaggcgcatcagaaaaacctccggctatgccggaggatatttattcaaaatgaatttaccaccagcccagttcggtacccgccaccgcaattagcgcgatgcccatcaacaccatcgttgttttcctcatggttatgctcccggtgcggcgtaaccgccaataaaaaaccatgccaaaaataatattgccgtaatgaaaatgacgacagggaagaggacacccactctcatgctattaccttcactgttcagggggcgccagaatagcagggttttctcagcgacaaaaggttggttgctttgtgacagggcgtggctattgctgacttaacccgggataaacacccactaaagcgctgacagaaagtatggaaatagcgtacccgccaggttatcctggacaaaatatcgctttaaggagtcgttatgaaatttacgtggattgcgttgccaggcgtattgctgctgagcgcttgttcatcgtcgcaacccaacgcccccaggccgccgcgtattgggatgcctaatccggcagccgtctactgtgagcaacagggcggtacgctgatgccggtgcagaccccacaaggcgtgcgttccgattgcaaattgcccaatggcgaaatcattgatgagtgggcattatggcgcagagagcaccctgatacgaaaaagtgacaacctgcggtccgacgggatatgattaagaacaatctgataatgagtttcatgcggcgcaagaaaatatgtttcagttaaagccgggcgcgttggcaatagttattggcgctaagacacccgccggacggcggaatattggtaaatcggttgagctattttgcctgtgccaacccggagatgaattcattaatccggtaaatggacacgtcaccttactgccgaaagaagcgcctcgggcgctgtggctggttacgggcgacgtagcctccgccgatggtcagcacggttttgcctgggtgcgagcagaacatttgatgccgttgtccccggacagacaaccaggccaggcggcggcacgacaatcacagctctcgtagccactctgccagcacaatggcatggttctggcgagtatctttagcggcgtatagcaacgttagcggttggtgtcgggcaatatccgccagacgtttgccttcttgatgctgttgcgcaagttctgcccggtattgctgcgcgaagtggttaaaatcaatcagttcgctatgaaaggctttgcgcaattcggtggagggcgtaatggccttattccattcatcatagaccagcgctgcttttttaatgcctcgcggccatagcctgtcaaccaatacccgataaccatcgtctttttccgccgggaaatagacgcgcttacactggattcgcatttttccctcctgtgatggtgtcgcttacggtacttttgtcggatagcagtaatgattttaatggatcaggcctgataaacgaagcgtcatcaggcattcaagtgggtatcaggtttatttatgacgctatctctcgatcgcgtccggcgtagaggccgaaaatcgccatgatgatagccagaaccgttacgcccgatagcggcagataccagctaccgctggcatcatgaagttttcccatgacgggcggcccacatgccgccagtaaatacccgaccgactgcgccatgccggaaagcgccgccgcctgatgcgccgaactggcgcgcaggccgataaacgtcaggccgaggatcatcgtcgcgcctgaaccgaagccgaacagtagcgtccagatgatcgcctggcccagcacaaaccaaagccccgccgcgcccagtgcgcacaatagtgagaccagcgcggcaatccagcgttgaacgttaaagcgatgcaaaataagcggaatagctaacccaggcgccgcggtcgccagttgcagcaggccatgtagcgatcctgcctgtgcttcgctgtaaccgtggctgatgagtattgttggtaaccagccgataatcacataataaatcagtgagttaagcccaagaaacagagtaacttgccaggctaaaggcgaacgccagataccgcgttcatgtaatgcccgggagctactcaggttagctgagcgggtagtgcgccactgcggcaaccagataagaaacgccaacagcggaaacagcatcagcattaacagcgcgctgcgccagccaaaaccgtgcaacgccagcggaaccaccagcgcagaccccaacgcggcggcggcgcccatcgtcaatgagtacgcgcccgtcagcctggcgacatgttgtgaaaaatcgcgcttaatcaatcctggtagcagcacattacccagcgctatcccgcacccaataatggcagttccggcaaacaacaatgcagcggagggcagggagcggagagcaatacccgcgcaaatcagcagcattgcggcaaacagactgcgttccatcccaaaccggcgggcaataccggccgccagcggcgaaatcagtgcaaacgccagaagcggcaaggttgttagcaggcccgtctgggcggtggaaagaccgtaatccgtacggattgtctccagcaacggcgcagcgccggtaaatgttacgcgtagcgtagtggctatcatcaaaataccggcaatcagtaaagcgccctgtttgccgcgtggtgaaagggctgtcgtcatcgttttctcatctcgtcaggcgaggcgataccttaacagtttttactgtttggatgaatcaagctaaaatgacaatttatcgctaaaatcggacaatataatgattggcctgagactggacggttacgatcccgaccttcaccacgatgccgctgtggccttttgtattcgcgccagggatgatgaactgtttagccctcgccatcagcatcgcaagggacagttgatcctcgctctgcacggcgcgatcacctgtgaggtggaaaatgcgatgtggatggttccgccccagtatgccgtctggctccccggctcgctgccgcacagtaatcatgtgaccgcaggggcggagctgtgctttttatttattgaacctgcggcggtcgtcatgccggagcgttgctgcacgctgaaaatttcgccgttatgccgggagttgattttgtcgctggcgcgcagaaccgattccgaaagagcgcaaatgccaacgcagcgccttattcaggtgttgtttgatgaactgccgcagcagccgcaggaacaattgcaattaccagtatcggggcatccgaaaattcgccaaatggttgagacaatggcgcaggagcacgcgcgatggaatacgttagggcagtgggccagcgtattcgcgatgagcgagcgtaaccttgcccggctggtcgtcaaagagacgggactcagctttcgtcgctggcgtcatcaattacaattaattctggcgctacaagcgctgatcgcgggacgtaatgtacaacagacggcgcaaatgctgggttatgattctaccacggcattcattacgatgtttaaaaaaggcctggggcagaccccaggccagtatctgacgggcgagttactgctttcccacaattaaagagaccagccccgccgcaatcagtgggccgaccggcacgccgcgaaacagcgcgacgccaagtaccgtaccgaccagcagcccggcgacgagctgcggttggtttcccatcagcgtaatgccgcgaccacccagccaggagacgaaaacgccgacggcaatcgcgaccagcgatttccagttcacaaaagagtggatcaatgtggagggcggtagggttccgctggcgatgggggccatcacgccgatggtcagaatgataatcccgacggtgagcccctgtttttcaatccagggaaaaaaggtattcaacggggttacgcggacaataatcagcaccagaattgagacggcgacagtggtgttgtgactaataaatcccagagctgccagtccgagcaggatcagcagagtgacatcaaacattatggtttccttgccaaaaagtaagcctgactactttacgcccaaacggcaaagcgcacaggcctttttaacgattgatgcggatttcaggcaactgcctgaaagacaatttctacgtgaaaaacggcgttgtcattaaattgacatcaacgccgcgtattgctaaccggtgaaccgtcattgttgtcttcctgaggatacaattatgtacgatccaccgtttcttgaagcgctgatgataacagcgtcgtttttcgccatttttatcattattgttgtgtctgtattgctccttgaaggggactaagccgttggcgatgactgaaagcggcggaagactgccagttctggtcgggcgatgcgcagatagtcctgtgtattcataatgactgatttttccagcagaccggcattaaaggcaatttcatcgaaacgctcaaacaggagcggatcggcgaccagtttcagattggggtgaaaactgaaaggcgggatcgcgccaaaaacgcagccggtcaacatatcgacttccgccgggctggcaagggaagcgcgtaagccgcccagatgtgaagcaagctgagagaggtcggcttgctgatcggccgccagaatagcaagaacgtgctggttgacgccgttgcctttgactttacagaccagcgcttttgcgccctggcccagcgcagtaccgcgtatttcagataccgcttcgcattttcctactgcttcatggctcaccacacgatagcgcgcgttctcctgggttaataaagccactaaacgttggtgtgtagcgacacccttcgcgacttcagccatttcggccatttcttcctcctggtacaatatgaacatttactgcgaagcactatgatgaacgatgttgtttttgttgtttgttcagatagagctgcgcatcggaagcctggtaggcatcattaatcgtatcattgggctgcatattataaatcccggcggaaaaatggactgtcttatccggtgcgataatctgcaggttacgaataatacgctccggcagatggatagccaaatccgccgcgtaatcaacaagaataatacagaattcatcgccgccgaggcgaatggcgtaatcgcttttacgaatcgatgttttaatcgctttcgccaacagggttataattcggtcgccttcctggtgccccagggtatcgttgatcagttttaacctgtcgcaatcaatagcgacaaatgtcaccggcgtcccggtattgaccaggcgttgcagtcgctgttccagcaccggtgttaatattttacggttgtaaagcccggtcatggcatcgctaatattttcgcgtgtgacgttgcgataaagccgaaagtgcatccgtaccatattaagcaggagcgctgttgccagtaagtaaaaggccagcgctttccaggacgagacaaggaaataggttaaatcaagcgacaacgaaacgcgcagtccaccagggatatcatggttataattcacatattgaaacagattatttttgcttttattaataataatttcttttccggaatccagatcctttagtgttacgttaagataacgccaaaccagcggacggtcctgggtataaaaaatattttttaaattatcctggttaacatccaccatcacgatgccttttaacgatcccgacagatagactggcgttaaaaagctcatgacgttttcctgggtaatatcatccatgtagatacttgaaataaccgtacggccggtaaaaagtttatctatatcttttctgttaatacccattgtgcctttttgtaaaaaagtccaacgatgcatggcgaagcgccgtgagttgattaaatcatagaaatagacataatgtttatttaaatcaacgtaataacggaatttaagctccagtgtgcccagcccgtgactgtggtcgtcctgcgctcggttgatgcttaccgcctgatcaaatgcaggcagtaaaagggcgtcatcaagattatcggtacactgtgtagcgacggtttgcagggtgccatgtagcgccggataattatgccgggtcaggttgacgccgtgcgtaccgttaatggcctcaaaggcgtcgcaaaacgcgcggcgtttttctgcggtgacggggtctcccggcgcttcaaaagttcgcatcaaatgtgcggcgatgctttaattctggtacttatcgtacaaaaacgacgaatcggctctctccatgatataacgcatataggcattcattgccctgtcgctggcaataagttcgtaaatcaggaaggacgatgtcaaaacgatgacgcttgccgagataaagtgcctgagcgctttatgatgcaaattcatgatgaactacagccctgaaagtcggatgcgttagtttaccatagcgatgagaattcctctaacagactgtttaaaaataaaacgtgttgatgttatggaataaaaatcattctcgatttaataaattcaataatatatggtgttgatattttcagtcgtgactattgtcgcaaaaagtaaattgttaattaacggcatcgatttaacactaacgaaaataaaatagcctttattattacgtgaaaggagtgtgacgtggtaaggataataatgtacttccgttcggaggtactatgaaacgatttaaagaaatagcagcaattttgctttttgcattgctggccgtggggttcacgtcgtcggctatggcatcgtcgggcagtggtggtggcccgtgggattttgatatctattttcctggtcactactttttttgcaaactacaaccccctgattctctgcaattaccgccacctcctggtgagtattgctggcattaataaatccatactattccagtgataagtcggcgcatgtaaggtaaatccagtcaggagatatacaggtttacggctattgtagtggcaatatgtataatcgccttgttagtgataaatcagcccgtgacgcattacgggctgatttagggttatgcactttgattggcgctctgtttctgaaacaattcgcggaataccggataaatatcctcctgatcgcgaatatgctgcatggcgaagttatcgaacgtcgcctgcagatgttcatactcgcgccataaggtctggtgggcgcggcgggtaatctcgatatagctgtaatagcgcactaccggcagcagctttttcgccagaatctcatgacacagcggtgaatcgtcggcccagttatcaccgtctgacgcttgcgccgcatagatgttccactgactggggtcgtagcgctctttaactacttcgtccatgagtttaagcgcgctggagacaatcgtccccccggtctcttgcgaataaaagaactcatgttcatccacttccttcgcctgggtatggtggcggatataaaccacttctacgttcttatacgttcggctcaaaaacagataaagcagaatgtaaaaacgcttggccatatctttggttgcctggtccatcgaacccgagacgtccatcagacagaacatcaccgcctggctggagggctcaggtcgtttttcataatttttatagcgtaaatcaaaagtgtcgataaacggcactcgctcgattttagcccgtagttcggcaatctcccgacgtaaccgctcctcttcaagcagttgcgctggttcgctgtggctgatggtctccagttccgtttccagcgcgtgcagttcgcggcgttttcctgccgtcattgctgtacggcgcgccagagagttttgtagcgaacgtaccacgctgatattggccggcacgccgtttgaggtgaaaccggcgcggtgagttttatactcgttaagctggcgatgctggttttttttcagattaggcagcgctaaatcttcaaagagcagatccagatactcatcttttgaaatctgaaaaacaaactcatcctggccttcgccgtcctggctggcctgaccttgaccgctgccggaaccgccgccgccaccgctttgcggacgctcaatgcgatcattctggataaagtgatcgttacccggatggacgcgatggcgcagaccgccgcgcccctgatgaaacatcggttcgctaatatcatcggttggaatagagacggactctccgctgtcgacatcggtcactgagcgtttattaatcgcttcggaaatcgactgcttaatttgtgctttataacgacgcaaaaagcgctggcgattcaccgtgcttttatttttgccgttaagacgtcggtctatgaaccaggtcatatgccccccgtactgccaactgagcgcctgttctgttagtgccggatagcgctaacgcttagccagtctacagaacattactttgtaggcccggtaagcgcaagcgccaccgggcattaacatcacgacgatttacgcacgcgcaggtaccactcgcacagcaaacgaacctgcttacgggtataccctttttccatcatccgatcgacaaagtcgtcatgctttttctgctcgtcagtcgacgttttggcgttaaaagaaatgaccggcaacagctcttcagtattagagaacatttttttctcaatcaccgtgcgcagcttctcgtaactggtccagtttggattacggccgctattgttggctctggcgcgcaggacaaagtttactatctcattacggaaatctttcgggttactgatacccgctggtttttcaattttttccagttcggcgttcagcgactcgcgatcgaacagttgaccggtatctgggtcgcgatactcctgatcctgaatccagaaatccgcataagtcacgtaacgatcaaaaatgttctgcccgtactcagagtaagattcgagataggccgtctggatctccttgccgataaattcggcgtatttcgggatcaggtagcctttcaggaactccagataacgctcagcttgctcctgcgggaactgctcgcgctcgatttgttgttccagaacgtagaacagatgtaccgggtttgccgccacttccgcatggtcgaagttgaatacgcgggagaggatcttaaaggcgaatcgggtggagagaccgttcatcccttcgtccacacccgcatagtcgcgatactcctggtacgatttagctttggggtcggtatctttcaggctttcaccgtcataaacgcgcattttcgagtaaatactggaattttccggctctttcaggcgggaaagagtcgagaagcgcgaaagcgtttccaatgtgcccggcgcgcagggcgcatgagccagctcgctatgattaagtagtttctcgtagattttgatctcttcggagattcgcaggcaataaggcaccttcacaatatagacacggtcgaggaacgcttcgttatttttattgttacggaaagtcacccattcagattcgtttgagtgggcaagtatgatgccattaaagggcagggcggaaataccttccgtaccattgtagttaccttcctgagttgcggtcagcaaggggggcagcaccttaataggcgctttaaacatctcgacgaactccatgatcccctggttagcgcggcatagcgcgccagagtaaccatacgcatccggatcgttctgggcgtgatgttcgagtttacgaatatccaccttgccgaccagcgccgaaatatcctggttgttttcatcgccgggttccgttttggcgatggcaatctgctccagaatggagggccagactttcaccacgcggaatttagtaatatcgccgccaaactcatgcaggtgtttggccgcccacggggacataatcgtaccgagatagcggcgcggaataccgtactctttttccagaatctgcgcgtcttcctgcggattaaacaggcataacggatgatcgttgaccggactacgctcgccgttggcgcttaaaacataaattggcacgcgctgcattagcgatttcagccgttcagcgagcgatgatttgccaccccccacaggtcccagcaaatagagaatttgcttcttctcttccagcccttgcgccgcatgtttcagataagagacaatctgttcaatcgcgtcttccatgccgtaaaactcttcaaacgcaggatagcgagcaataacccggttggagaagagtcgggaaagtcggggttcctgggcagtgtcgaccatattaggctcgccgatagccattaatagccgctctgccgcgttggcataagcactgcgatcttgccgacaaatggtaagaaaatcctgcagtgtgaactcttcgtccttggcagcttcgtaacgctggcgatagtgatcgaatatattcatgatatgccattctttcgttttttcgcacatgttaagagccgttcatatgaatagtagaggctcccggaagaggtagactgaacgccgtctctgctaaggaaaaaaagcaactctcatgccattttattggtcagaagatcaacgtgtccggtgatacaccttcttaacattaagcgtagatggcatttgcaaaacttgcctgtacgcgtcagtgaatttcgatgacatatcaataactcatcaggtagaaaaggctggtggatatcagaaaaagcgttcccggccacataacgatcatcagccgatcatctgaaaataatcggtgatggtgatattaaacggttacattgtgtaaaatagttgggcttacaggtattggcggttacacttttgccgcagaacatttgaataaggaattatggattgtgaccaaacttaaacttctggctcttggcgtgtttattgcaacatccgccagcgtcgcgcacgctgaaagcaacctgacgttgggcgcaggcgttggtgtggttgaacacccttataaagattacgatagcgatgtttatccgataccggtcatcgcttatgaaagcgaaaacttctggttccgtggtctgggcggcgggtactacttgtggaatgacaatgccgataagttgtcaatcatggcatactggtccccgatgtacttcaaaccgggcgacagcgatgaccatcagttgcgtcgtctggacaggcgtaaaagtactatgatggcgggcgtttcttacgcgcaccacacccagtatggattcctgcgtacctcactggcaggggatacgttagataacagtaacggtattgtctgggatctggcctggctgtatcggtataccaatggcgggctgaccttaacgccaggtatcggggttgaatggaatagcgagaaccagaacgattactattacggcgtatcacgtaaagaatcttcgcgtagcggcctgcgcggctataacccgaacgatagctggaacccgtatcttgaactgagcgctaactataatttcgccggtaactggagcgtatatggtactgcgcgctacacccgcctgtcggatgaaattaccgacagcccgatggtggataaatcctggaccggtatcctttctactggcgtgacctatagattctgattgattgaatttgccggaaaaaccatgacaaagcctgcgttatgcgggctttgtgctgtctgaaacgcgaacatggcggcttgcataaatgcgctgttgaccgggtatggcgcagccttacgtgatttatactttgttacatcaatttaaaaaactagccttttatatgaaaaatccaggtgattacaactgcgctaacaattagcgtaataattgttgcaatgctggctgatatcgccctgtcacgtcccgcttatgctatacccattcttcacagcgagtaagacgaatgagcatagtattcaataccgtggccaagcccagcggcagtctgtgtaacttatcctgcaagtactgtttctatcttgataaaccccggggccagcgcgtcatgtctgacgatgtgctggagacgtatatccgccgggtaattgatgatacgccatcatcagaggtctcgttttgttggcagggggagagccgacgctatgcggtctttctttttatcaaaaagtggtgtgcttgcagcaacgctatgccaacggcaaaactatttacaacagtctgcaaaccaatggcgtattaatcaatgaagagtgggcggctttctttgtgcagcaccagttcctgattggtatatcgattgatgggccgcaagtcgttcatgataattaccggagaacgccgtcagggcgggcgtctttttcccgagtcgttaatgctatccgccttctgcaggcaaatgatgtcgagttcaatacgctcactgtcgtgaatgatgcatcatgccgtcatggcaacgctatttatcattttttgacgcaggaactggaaagtaaacacctacaatttattcccattgttgagccgctcgcgcaaaaagcgcagcgttctttgacgttatctgacaatgaagattcgccttcgctgatgcccttttccgtcacgcctgaagggtggggggcctttatgtgcgatgtttttgatcaatggatacgtcacgatgtcggacgcatattcgtacagctttttgataacttacttggcgtctggatgggggagcccgccacgctttgtacgatgcagtcgacctgcgggcaaagtttgctggtggagcagaatggcgacgtgtttagctgtgaccattttgtttttcccgcctataaactgggcaatctgcagcaacactctttagaagaaatggcggcctctccttttcagcagcagtttggcgcggctaaagcaaacctttcttcacgctgccagaactgtacgtggcgctttgcctgtcacggcggttgtccgaaacatcgaatttgtatggacggcggcgaacggcaaaattatctctgtaaaggatatctggagttctttcaacatgtgacgccctatatgaatgtgatgcgtcaattattactgaatcagcgacccgccgcgcatattacccgcatcgtcgacatgattgcggatgacgttcgtcagtgacaagaaaatcgccccccttgcgcggtatgatgccggacattaccgtagggtctaagagtcctgtattgttttaccgtcgagtgaaattgaaaaggaaatgaaatcagtgaaaaacgtaacgttttgcgggcaggtgacgcttcctgccatcggacagggaacatggtatatgggcgagcgcgcggatcaacgtcagcgcgaggtttcggcgctgcgcgcggggctggatttggggttacgccttattgatacggcggaaatgtatgccgacggcggggcggaaaaggtcgtgggcgaggcgttagcagggcgacgcgatgaggcatttctagtgtcaaaagtgtacccgtggaacgctggcggccagaagatagttgccgcctgtgaggaaagcctgcgtcgtctgaaaacagattatctcgatctctatctattgcactgggccggaggcttttcattcgaagagaccgttgaaggtatggagcggctaatcgcgcagggaaaaattcgccgttggggagtctctaatcttgattatgacgatatgcaggcgctgtggcgcatccctgggggacagcaatgcgcgacaaatcaggtgctctatcatctggcgtcacgcggtattgagtatgatttattgccgtggtgtcaacaacagcgaatgccagtgatggcctatagcccgctggcgcaggctggccggttacgtagcggtttactgaatcatccggtggtgaatgaaattgcgcaagcgcataacgcaacggcggcgcaaatcttactgacgtgggtgattgcgcatccgggcgtgatggcgatcccgaaagccggaagtacagaacacgtgaagcaaaatgcggcggcgcttgagattaccttgtcagcaaacgaacttgccttactggacaacgcctggcctgcgccaaaagggaaaaccgcgttggatatggtgtgacgccggataaaatgtgtaagtgccgccatccggcaggtcatgcctgatggcggctggcgccttccagagcctatagcaacgccgttatccattcacttttagcgtttagcgacgcagatagtctgcgccagacgagagggtttttcttctgtggcttgttgcggcgcagtagcgtaaaccgtttcaacgcagacaaacgttttatagccgtcatccggcatgtcgcccatgctgacggacaacgccgggccagggttccagcctacgacgttaaggtgatggtggtggaccacatcaatcgtgcggtttaatgtcgcatcgtggatcacgctacatgcttcaggattgaggtaaacgcgatcggtacggtccggaaaggtttgtataccgtcggctaggacatcttctttagcgtcgttaactttatcaataaaccgatcgccgagtccgctgaccttaacgttggcgatgtcgccaacgttaaaatagctgtggagcgcggatgtggttgcaaattcgccatgcgcttccagttcaatttcacaggttttacccactttaaaacgtgccagcagcgtgaaatcgtgcggccagtatttccgggtggcctcactgctttgcagctcaaatgtcagcattacgccattatcatcttcattatgcgcttttagcgcccacggaagattacgcgcaaagccgtgtgacggcagaccctgttgagccgcaggtccaaaccagggccagcagatcggtacgccgccgcgtagcgccacgccggttttgaaaggcgtattattactgagccacaatacctcttcctcgccaatgggtttctaggagagaaggtgcgcgccctgtaatgcaaaagaggctttaacctgcggatggtcaacgacgatcagatccaggtcatcaagctgacgacgggaaaggacaggggtaagctgttcgataaccgggagggcaaaaattttattaatcattacgcaatcctcttaaccctaaataattcgagttgcatgacaaggcgcttgtgccttgaccagtgcttgcgctggcccgtagaggcgaggccgcaggccgagtaacgcggcaagtgaacgacaaattcatcgggaacgaatttgaacaaccgtaggtaaccttcggtcaggggcatccctgattcatcccgataagttcgacttccgtcagtgattcgggtgagaaagcatagccaacacacctgcaacttgaagtatgacgggtatatctttaagcaaaaaaaagagcgacctgagtcgctcttaccaatgactgtgtcatctcaacttatttggagatgtgagcaatcaggtccagtactttgttggagtaaccggtttcgttatcgtaccaggagaccagtttcacgaagttgtcgttcagcgcgatgcctgctttagcatcgaacacggaagtgcatacttcgccgttgaaatcggtagatacaacgtcgtcttcggtgtaacccagaacgcctttcatttcgccttcggcagcagctttaacagcagctttgatctgctcgtaggtagccgctttttccagacgaacggtcaggtcaacaacggatacgttcggagtcggaacgcggaacgccataccagtcagtttgccattcagttccggcagtactttacctaccgctttagcagcgccagtagaggacgggatgatgttctgagatgcgccgcggccgccgcgccagtctttgtgagacgggccgtcaacggttttctgggttgcggtagtcgcgtgaacagtagtcatcagaccttcgatgatgccgaagttgtcgttgataactttagccagcggcgccaggcagtttgtggtgcaggaagcgttggaaacgatgtcctggccttcgtatttgtcaaagttagcgcctttaacaaacattggggtgttgtctttagacggacccgtcagaaccacttttttcgcgccagcggtgatgtgtttacgcgcggtttcgtcagtcaggaagataccggtagcttcagccactacgtcaacaccaacttcgtcccatttcaggttagccggatcgcgttcagcggtaacacggatttttttaccgttaacgatcagatgaccgtctttcacttcaacagtaccgtcgaaacggccgtgagtggagtcatatttcagcatgtatgccatgtactctgcgtctaacaggtcgttgattgcaacgatctcgatgtcagaacgtttctgagcagcacggaaaacaatgcgaccgatacggccaaaaccgttgatacctactttgatagtcatatattccaccagctatttgttagtgaataaaaggttgcctgtaaaattacaaaaaccttacgcagcgtcaagcggaatcgtgtcaatcattgcgacaaatcaatcctctgcacaacctttgcgcggctgattcgcctcactcttcctttcagcttgaaaccacatgggggcgccgccccgaattttaaagggcaaccgagataataatgtgacatcagtcacgattcgtgagccgccatttcgcaatgatcaagtttagaacaaaagttggtactgaggtgctaatgttttgttagaatcggtcaggcaatgtgagcacgtttaaagtgagatgtgagcaaatggctaaccaaccttcagcagaagaactcaagaaaaaattgtccgaaatgcaattctatgtgacgcaggatcgtggcacagaaccgccatttaccggacgcctgctacataataaacgcgatggggtttatcactgcctggtctgtgatacgccgctttttcactcccacaccaaatacgattcaggctgcggctggcctagcttttaccagcctgtcagcgaagaggcgattcgttacatagacgatttttctcatggcatgcagcgtgtcgaaattcgttgcggtaactgcgatgcgcatctcggacacgttttcccggacgggccgcagccaaccggtgagcgctattgcgttaactcggcctcgctggccttttctgacgagaaaaacggcgatcaactgaaaggctgaaaaaacgattcagcaaattattccacaggagcggacacatcatgaatcttgatgagatcattaacagcatgacgccggaagtgtatcaacgtttatccaccgccgttgagctgggtaaatggccggatggcgtggcgttgacgccggaacagaaagaaaacagcctgcaactggtgatgctatggcaggcgcggcacaataccgaagcgcaacatatgacgatcgatactcacggtcagatggtgatgaaaagcaagcagcagctcaaagcggatttcggtattacgtcaaagccgattgcgacattgaaaatgcagtaacggcagccggataagaggtagtcgccatccggtggtttaattgccaatgcgttgtgcttaccgggcctgctcattgctgtcaggcacaggcccgccatatttttacccattacgcttaatgtccagcgagtccgccaactgtttcgctaactgattattgtcattggcggcctattcccagaacattgcgccggccagcccgcgctttttaatctgtttcgttagaagcgctctccagcctgcgttgagctttgcctggtagcgacgctgacgtgacgtatccggcccaaagatctatgcaatggtctcaccgttgcgtgatgtattgaccggatacgatacctgctccgctacctggcgatagcctggccctgcgtctcttcccagtctgccagcgtatacagcgtcgcgcctgccgccgccatctccataaacgcgtgtgcgctatcctgcgggtgaatattcacgccgcgacagccatcggtgataacgttaacggcatagcccaactctagcgcatccagcaccgtaaattttacgcagtaatcggtcgccaaccccatcacgataagctcggtaacgtcatgctcgcgaagccaggtatcaagggtagttttctgccgatgttcgttgtcaaaaaacgcgctgtagctatcaatcagcgggttttcacctttatagatgcaggcgtcaatcgcatgttggttaagcaggggatgtaacgccgcgccgtcggtatgttgaacgcagtgatccggccagagcgtttgcggcagcccgtccagctttccctgtctatagggttccgcctgatgctggctggcgaagctgccatgctgcgcgggatgccagtcctggctggccagcaccggaatctgccggggctggcaccagtcaataagagcgttggcgatgtcgatggtgctgtcgccttccgctacagccagcgcgccgccggcacaaaagtcattttgcaagtcgaccagtaataaggcccggtttgtcattatcttctccttgtcgtcgggattttttaatcatccggcgtcaattcaccacgcaagttttgcgccatcgcgctacgaatcgcctgagtgtccagaccctggcttaacaaataatgcagtttggttaaggtagcttcgacggtcatatcggcaccgccaatcacgccagcgtgcgccagcgcattaccggtagcgtacccgcccatattgactcgccctgacatgcattgcgtcaggttaaccaccacgatgccgcgcgaactggcctctttcagctcctgtaaaaacgctttattttgcggcgcgttgcctacgccataagagcgcagaatcagcgcttttaccggctgacgcagaaagttacgtactacctcggcggaaatccccggataaatcgtcactacgcctatcggctgcggcgtaatagggtgaacgattaattcaccagaaccgtagggcgcgggaggcgtatttaaacggcgaatgtgaattcctgcttccagcaagggcggcagattaggagaggcaaaagcgtcaaaaccatccgcatgtgctttggtcgtgcgattgccgcggaacagacgattattaaaaaacagcgttacttcattaacagggtagttggcggcgacataaagcgcattcagcaaattaatttgcccgtcggagcgcagctcagccagcggaatttgtgaccctgtcacaataaccggtttacccagattttccagcatgaaagagagcgccgatgcggtatacgccatcgtgtcggtgccgtgcagaataacaaaaccgtcatactcatcgtagtgcgctttgatatctgcagcgatatgctgccagtcttccggcgtcatatctgatgaatccatcagcggggcatattcatggatggtaaaatccggcatctccgggcggtggaattccggcatcagcgccagctgacgctgaaggcgcccggacaccgggatataccctttatcggagcgctgcataccgatagtaccgccggtataggcaacgtaaattgatttcttttgcatgataatgttcagtcgtgtcgcgaaggacgtattaatgattatcggatggcggctatgagcagacgccgacatccggtatggctattgatgaagcattagcgcacgttcgcgcaagtcaaacagaacgcataacggttttgtggatcgttaaatgccgccagtttatccccctcggccttcaccgtgttggcggcggaaacgagcggcgccgggagcatcgcctgaatggcctccggcagcatggcgcgtacagatccggtcatactgtccatgaccatatcaaggactgtcggttcgtcctgatagtaatcaagatgccactgtttcagtttcgccagctccgccgctttggcgacggcgtcgtcaaagtcgccgagactgtccaccagaccattggctttcgcgtcttctccggtccagacatggccttgagcgattttgtcaatctgctccggcgtacgcttacgcgcgtctgccaccagcgtgataaagcgtttgtagccgtactcaatactgagttgcatcatctgctgcacttccggtgacagcgctttagtcatcgaaatatccgccagcggcgaggtggaaacgccgtcgctgtgtacgccaatcgacgacaggctgttttctaccgtattaattacgccgaagatgccaattgaacccgtcagcgtgctggggctggccacgatatagtttgccggcgtagagatccagtaaccgccggaggccgccatgccgcccattgagaccaccaccggtttgccagccgctcttgccgccgccagttcggcgcggataacttcggaggcgttgacgctaccgcctgggctattgacgcgcagcacaatcgctttcactttaggatcaaggcgtgcgtcgcggatctgcgatgccgtagtgtcgccgccgacattccctggcgtttcttcgccatccataatcgcgccattggcgaaaataaccgcaatagtaccgccggtatccgcaggcgttttcagcgaataatcgtaatagctgatcgcgcgatagttattttcggttttgctccagccaaactgcttcgtcagcgctttttcaacatctgcgctggaggcgagggcgtccaccagtttatggtcgagcgcatatttggcggtgtcaccgcccacgctggttaacccgtcgataatagcctgggcgccggggaagagttgttgcggcgaaatctggcgattggcggaaacggtatgcaggtagttctgccacagttcgcctatccagcggctgtcggcctcgcgggcggcgggcgacatatcgtcgcggataaacggctcgacggcggatttataggtgccgacccggaaaacgtgggtagagactttcagtttatccagcagcgttttgtagtacaggccattcgtagcgaagccgtgaagatctacctgaccctgtggggaaagccaaattttattggcgaaactggcgaggtaatactgaccctggctgtagttttcacccacggcgaaaaccggtttgccgctatcgcggaattcgcgcagcgctttaccgatatagcgcattgacggctgatcggcaccggtgaagtttttcagatccagaacgatacccgtgatgttacggtcatctttcgcctgacgaatagcgttgacgatgtcaaacagggagttttcctgcagacggtcggagctggcgccaaataactggcgtcccagcgcgcccagacggtgattggtggagggtttatccacaatgacgccggaaatatccagcagcaaagcgccgcgcgccgtttgctcactgttgctgccgttaccgatctgcatccagatcccaacgcccaccaggaccagaaaaataaagaacaggttgagtaccatttcacggacgaagttcaacactcgccacgtccatttaaaaaatccggcaataaatcgccacagggttcgcatgtattctccctatctgagtaacaacgcttataccttggtgaggataaagcattaagatgtggctatcgtaatgacccatcaggcagttgtcagcaggaatcactgcctgcgctgtaacaaaatccgctcccgtgttaattttgtgaataaatatcattgctggagttaatcaaatggatgcactagaactgctggtcaaccgtcgcagcgcctctcgtctcgcagaaccggcgcctgtcggagagcaattacagaacattctgcgggcgggaatgcgtgttcccgatcataaatctctacagccgtggcgtttttttgtgattgaaggagaggggcgcgaccgcttcagcgccgtgcttgaacaaggcgctgtcgctgccgggggggatgagaaagcgatcgaaaaagcgcgtaatgcgccgtttcgcgcgccgctgatcattaccgtggtggcgaaatgcgaagaaaaccataaggttcccgtgtgggaacaggagatgtctgccggatgcgcggtgatggcgatgcaaatggcagcgattgcgcaagggtttaatggtatctggcgtagcggcgcattaacggagagcgctatcgtgcgggaagcctttgagtgccgtcctcaggataaaattgttggttttctctatctcggcacgccgcagctcaaagcgtcaacgacgatcagtacccccgaccccacgccgtttgtgcgttatttctgacgctgagggataaaactgtctggattctgagcaaaggcgcggtaattcagacagtgatacttaccacatcagggaatgagcgctaccatagcgcgaatgcaatgacaggagatgtccatgagcaagcaagccattcgtttaacgcaatacagccacggcgctggttgcggttgtaaaatttcccctaaagtgctggagactatcctgcatagcgagcaggcgaagttcgtcgacccgaatctgctggtgggtaatgaaacccgcgatgatgcggcagtttacgatctgggtaatggcaccagtattatcagcaccactgacttctttatgccgatagtcgacaacccgtttgattttggccgcattgcggcaacaaacgccatcagcgatatttttgcgatgggcggcaaaccgattatggcgatcgcgatccttggctggccgattaataccctgtcgcccgatattgcgcgtgaagtgaccgagggggggcgttttgcctgccgtcaggccggtatcgcgctggcgggcggacactctattgacgccccggagccgatctttggtctcgcggtcacaggcgtagtgccgaccgaacgggtgaagaaaaacagtaccgcgcaggcgggatgcaaactctttctgaccaaaccgttggggattggcgtgttgaccaccgccgagaaaaaatcgctgcttaaacctgaacatcaggggctggcgacggaagtcatgtgtcggatgaacgttgctggcgcggcgtttgccaatatcgacggcgtaaaagccatgactgacgttaccggttttggtctgctgggacacctgagcgagatgtgccagggtgcaggcgtacaggcgatgctttgctatcaggacatccctaaactgccgggcgtggaagagtatattgctctgggcgccgtaccgggcggcacagagcgcaacttcgccagctatggtcatctgatgggcgacatgtcgcgtgaagttcgtagcctgctgtgcgatccgcaaacgtcaggcggtctgctgttggcggtaacgccggacgccgaagacgatgttaaagccaccgcggcggaatttggtatcgaactgaccgcgattggcgaactggtcgaggcccgcggcggtcgcgctatggttgagattcgttaacctgatgcggttgtttattgccgaaaaaccgagtctggggcgcgccattgcggatgtgctgccaaaaccgcaccgtaaaggcgatggttttattgagtgcggaaacgggcaggtcgtcacctggtgtattggtcatttgctggaacaggcgcagccggatgcgtatgacagccgttatgcgcgctggaatctggctgacctgcctatcgtgccggaaaaatggcagcttcagcctcgtccttccgtcaccaaacagctcaatgtgattaagcgctttttgcatcaagccggtgaaattattcacgccggcgacccggatcgcgaagggcagcttctggttgatgaagtgctggattatctccagcttcctgccgaaaagcgccagcaggtacggcgttgtctgataaacgaccttaacccgcaggcggtcgagcgtgctatcgacaggctgcgggcgaacagcgacttcgtgccgctgtgcgtctccgcgctggcgcgagcgcgagcggactggctgtatggcattaatatgacccgtgcttacacgatcctgggccgtaatgccggctatcagggcgtgttatccgtgggacgcgtgcagacgccggtactggggctggtggtgcggcgagacgaagagattgagaacttcgtcgccaaagacttctttgaagtgaaggcgcacatcgttacgcctgccgacgagcgttttaccgctatctggcagccgagcgaggcgtgcgaaccttatcaggatgaagaggggcgtttgcttcatcgtccgctggcggagcatgtggtgaaccgaatcaacggtcagcctgcgctggtaaccagttataatgataaacgggaatcagaatccgcgccgctgccgttttcgctctcgacgctacagattgaagccgctaaacgttttggcctgagcgcgcaaaacgtgcttgatatttgtcagaagctatatgaaacccacaaactgattacctatccgcgttccgactgccgttatctgccggaagaacactttgccggacggcaggcggtcatgaacgcgattagcgtccacgccccggatttactgccgcagcctgtggttaatcctgatacgcgcaatcgctgctgggatgacaaaaaagtggatgcgcaccacgcgattatcccgacggcgcgcagttcttctgtccatctgacggaaaacgaagcgaaagtgtacaccctgattgcgcgtcagtatctgatgcagttctgcccggacgcggtgtttcgtaaatgcgttattgaactggaaatcgccaaagggaaatttgtcgccaaagcgcgttttctggcggaggccggttggcggacgttactgggcagtaaagagcgcgacgaggaaaacgacggtacgccgctgtcggttgtcgccaaaggtgatgagttgctgtgtgaaaagggggaagtggtcgaacgccaaacccagccgccgcgtcatttcactgatgcgacattgctttccgcgatgaccggaattgcccgcttcgtgcaggataaagatctgaaaaagatcctgcgcgcgaccgatgggctggggacggaagccacgcgcgccgggattatcgaactgctgttcaaacgtagctttctgaccaaaaaagggcgctacattcattctaccgatgctggcaaagcgttaatacattcgctgccggagatggcggcccgtccagatatgaccgcgcactgggaatctgttttgacgcaaatcagcgaaaagcagtgccgttaccaggattttatgcaaccgctggtcggcacgttatatcagctgatcgatcaggctaagcgcacgccggtgaagcgtttcagagggatagtcgcgccaggcggcggagaaaagaaaaagagcgcgccgcgtaagcgagcgggcaaaaaaagcccgcctgctgaggagacaggccgtcagaccgaataagcgtaaagccatctggcctggcgacgggattaaatgacgccctgcgccagcatggcgtcggcgactttcacgaaaccggcgatgttggcgccctgaacgtagttagtatgcttattgtcgccgccgtacttgacacaggcgtggtggatatccagcataatatgatgcagacgggcgtccactttctcggctttccagctcaaccgcgcggcgttctgcgccatttccagccccgatgtcgccacgccgcccgcgttggcggctttacccggcgcaaacagtacgcccgcctcaaggaagagatcggtcgcttcaatcgtggttggcatatttgccccttccgccacggctttcacgccattggcaatcagtacgcgcgcggcgtcaacgtccagttcgttctgcgtcgcgcatggcagggcgatatccaccggtacgctccagggctgctggccttccagataggttaagccaaactcacgggcgtagtcagcgacgcgaccgtcacggctggctttaatttcacacagccgcgccagcttctctggcgtgaagccactttcatcgaccaccgtcccgctcgaatccgacgcggtaaccacgcgcgcgccaaaggccatcgctttctcaatggcgtattgcgctacgttgccggagccggacacggcgacgcgcatcccttcaaaaccgagaccatgacgtttaagcatcgcttcggtgaagtagaccaggccatagcccgtcgcctccggacgaatcaggctgccgccgaaggaaagccctttgccggtgaagacgcaggcgctgttattggaaagcttgcgcatcattcccgccataaagcccacttcgcgcccgcccacgccgatatccccggcaggcacgtcggtatccggccctaaatggcgatacagttcagtcatcagcgcctggcagaaacgcatcacttcgccttcgcttttccctttcggatcgaaatcgctgccgcctttaccgccgcccatcggcaacgtggtgagggcatttttaaaggtttgctcaaagccgaggaacttaaggatggaaaggtttaccgaaggatggaagcgcataccgcctttataggggccgatagcagagttgaactgcacgcgccaggcgcgatttacctgcacctgatttttatcgtccagccacactacgcgaaactggattacgcgctctggttcaaccaaacgttccagtaaagacatgtggcggtaacgggggttttgttcaagaaacggccacagggtggtcatgacttcacggacggcttgcgcgaactcggtttgatgcgggtcgcgcttttgtacatggttgaggaacgattccagagaacatgtctgatccatagatataaaaacctcttatatattaatgtggttgtatttgcgttttatcagaatatgtatttgcagttttcgactataccatcagcaatgtgacggtaagcaagaaaaaaatgacgctgctaagtaaattcataacggggagagggtcataactaaaagcgatgacaaaagaggattaaagttttcacggcggcttaccgttatactgagaatatacttggaaaaataaggaaatcctatgcgccgaagcctcatggtcgccgtgatggcgataatgccaatggtcgggctggcaaaccaaaacagtcgtcctgatattcaggtgaatgtcccgccggaagttttcagcacgcgcggtcagtcatcccagccctgcattcagtgctgcgtttaccaggatcagaattactccgaaggcgcggtaataaaagtggaaggcgtcgtgctccagtgccagcgtgacgaaaaaaccatcagcacaaatccgttagtctggcgtcgcgtaaagccataaacgcctgcaatagcggaatatccgccggggcgagggggtattccagcgcctcttccggcgtacaccaggctaaggcctgatgttccagcgcacgtatcagaccgttaaacgcaggcacatgccaggcgtgcaaatgaattcgtcggccagacacgtcgcgttgatggctggcgatatagacgccgggcgtggcgtcaatccctaactcttcgcgtagctcgcggataagcgcctgcggttgggtttcgccgggttcgactttaccgccggcaaactcccataaaccggcttgatccgcatgaactgggcgctgggccagcagtattttgccgtcgcgttcaatgatggcggcaacaacatcgagtttttttatcattgtcgttaaggtcgttattcctgccgggaagcgtcgcgctatcccggccttacggttaatcagatagcggaatcaaacacgaaacgtcgcccagaccggcgcatggtcggagggtttttccatactgcgaatgtcgtagtctataccggtttctgcgcaacgttccgccagcggagcgcttgccagcaagaggtcaatgcgcagtccgcgattatccacgaaaccttttgaacggtaatcaaaccacgaaaatttatccatcgtttgcggatttgcctgacggaacgtgtccactaatccccacttcagtaaccgcgacatccattcacgctcctccggcaggaaggagcatttaccggtacgcagccagcgtttgcggttctcttcgccgatgccaatatccaggtcggtcgggctgatattcatgtcgcccataattaataccggattatcgcacttgagttccgtttcaagatagttttgcaagttctgataaaactgcgctttcgcggggaacttcaacggatgatcccggctttccccctgcgggaaatagccgttaatgacggtgatattacccagcggcgaggggatttccgccatgataatgcggcgttgcgcctcttcgccatcatccggaaaaccgcgtctgacggaaatgggcgtggcttttgttagcagcgcgacgccgtaatggcctttttgtccatgatagaaaacgttatagcccagcttcgcgacctcttcgagcgggaacatttcgtcgtggacttttgtctcctgtagaccgatcacatcgggctggtgtttttcgacaatcgcttcaagttgatggggacgggcgcgcaggccgttgatattaaaagagacaaatttcatagtcactgccactttgcaaggtgaatcgtgttgggatggtagcagaaattttaccgggtgactgccactcatcgtcagattcggccaatggaagcgtatggtgttttctatagcgcgaaaatggcacggtttgcgtgcagatgcgccagaacggggcggtaatttccagtaaatttcgtataagatcacaattccagaattatatttggcaactgaataatatttcgctttttcctctttctagccaccgattatgcggaaatattcacttttcatgcagtaaaagtgaatatcgctacgctgtaacccattgatttaccgtttatcacttctgtttatgcaatgttaacgctggctggcacgaatgctgcaatctacatttacagcgcaaacacccatattaattaacatatagataactttatttttaccaaaagaggtcgctatgtctctgtcagttacgcgcgaaaactttgatgaatggatggtgccggtatatgttcccgcgccttttattcctgtacgcggagaaggctcacgcctgtgggatcagcaggggaaagagtacattgattttgctggcgggattgcggtcaacgcattgggacatgcgcatccggcgctgcgcgaggcgttaaatgaacaggcgaatcgcttctggcataccgggaacggttacaccaatgaaccggcgctgcgactggcgaaaaaactgatcgacgcgaccttcgccgaacgcgttttcttttgtaattcaggcgctgaagcaaatgaagctgcattaaaactggcgcgcaaatatgcccacgatcgtgttggcaaccataaaagcggcattgtggcctttaaaaacgcgttccatggccgcacgctctttaccgtcagcgctggcggtcaacccacctattcacaggactttgcgccgctgccgccggatattcgtcatgcagcctataacgatctgaactccgccagcgcgctcattgatgacaatacctgcgccgtaatcgtagagcctgtgcagggcgagggcggcgtgatccccgccacgaacgcttttttgcaggggctgcgtgaattgtgcgaccggcatcaggcgttactgatttttgatgaggtgcagacgggcgtcggacgtaccggcgaactgtatgcatatatgcattatggcgttacgcccgatatcctgacgaccgctaaagcgttgggcggcggcttcccgatcggcgcgatgctgactacgcaagactatgccagcgtcatgacgccaggtacgcatggcaccacctacggcggtaatccgctggcgacggcagttgccggaaaagtactggatatcatcaatacgccggagatgcaaaacggcgtcagacagcgccacgatgcgtttattgaacgtctaaataccattaatgtacgttttggcatgttcagtgaaattcgcgggctggggctactgcttggctgtgtgctacagacggagtttgccggaaaagccaaactcatcgcccaggaagcggcaaaagcaggcgtgatggtgctcatcgccggtggcgacgtggtgcgttttgcgccagcgttaaatgtgagcgacgaggagatagctaccgggcttgatcgttttgccctggcgtgcgaacgccttcaggcgggaggcgcatcatgcgggtgattcgtcctgtcgaacatgcggatatcgccgcgctgatgcagcttgcaggcaaaacgggcggcggcttaacctcgctactggcaaatgaagcgacgctggcggcccgcattgaacgcgcgctaaaaacctggtccggcgagctgccaaaaggcgaacaaggatatgtatttgttctcgaggacagtgaaacgggtgaggtcggcgggatctgcgccattgaggtcgcggtcggccttaacgacccttggtataactatcgtgtcggtacgctggttcatgcttccaaagagctgaatgtatataacgcgttgccaacattattcctgagtaatgatcataccggcagcagtgagctttgcacgctgtttctcgatcccgaatggcgtaaagagggtaacggctacttgttgtcaaaatcgcgctttatgtttatggccgcgtttcgcgataaattcaatgagaaagtggtggcggaaatgcgcggtgtcattgacgagcatggttattctcccttctggcaaagtctcggcaaacgcttttttctatggatttcagccgggcggattttttatgcggtaccgggcaaaaagcgtttatcgccgagctgatgcccaaacatcctatttatacccacttcttatctgaagaggcacaggccgtgattggcgaagtccacccgcaaacggcgccagcccgcgtggtgctggaaaaggaaggctttcgctatcgccactatatcgacatcttcgacggtgggccgacgctggagtgtgatattgaccgcgtgcgggctattcgtaaaagccgactggtggaagtcgcggaagggcaacccgcgcttggcgactatcctgcatgtctggtcgccaatgaaaactatcaccactttcgggccgcgctggtgcgtgccgatccgcagacttcacgacttgtacttaccgccgcgcagttggatgcgctgaaatgtcgcgcgggcgaccacgttcggctggtacgcctttgcgctgaggagaaaaccgtatgacgctatggataaacggcgactggataaccggtcagggcgaacgccgccgcaaaacgaatccggtgagcgaggagatactttggcaggggaatgacgctgatgcggcacaggtcgccgaggcctgtcaggcggcgcgcgcggcgtttcctcgctgggccagacagccttttgcggcacggcaggctatcgtagagaaattttccgtcctgctggaggcgcataaagccgatctcacggaggtcatcgcgcgtgaaaccggtaaaccgcgctgggaggcggcgacggaagtgacggcgatgatcaataagattgccatctcgattaaggcttaccatgccagaaccggcgaacaaaaaagcgaacttgtcgatggtgccgcgacgctgcgccatcgtcctcacggtgtgctggcggtattcggcccttataactttcccggccatttaccgaatggccatattgtgcccgcgttgctggcaggcaatacgctgatcttcaaacctagcgagctaacgccatggaccggggaaacggtaataaaactctgggaacgggcggggttaccggcaggcgttcttaatctggtgcagggcggccgggagaccggacaagcgctgagttcgctcgacgatctcgacggactgctgtttaccggcagcgccagtaccggatatcagcttcatcgtcagctatccggccagccggaaaaaatcctggctcttgaaatgggcggaaacaacccgctcattattgaggatgcgacaaatatggatgcggcggtacatctgacgctgcaatcggcgtttattaccgccggacagcgctgtacttgcgcgcgacgccttctggtaaaacagggcgcgcagggagatgcatttctggcgcggctagttgacgtcgccggacgtctgcagcccggcagatgggacgacgacccgcagccgtttatcggcggactgatttcagcgcaggcggcacagcatgtgatggaggcctggcgtcaacgagaggcattaggcggtcgcacgctactggcgccgcggaaggtcaaagagggaacctctctgctgacgcctggcatcattgagctgacgggcgtcgcggatgtgccggatgaagaggtgtttggtccgctgctgaacgtctggcgttatgcgcatttcgatgaggcgattcgtctggcgaataatacccgttttggtctgtcgtgtgggctggtgtcgacggatcgcgcgcagttcgaacaactcttgctggaggcgcgggcagggatcgttaactgaaataaaccgctcaccggggcagcgagtactgcgccgtttggtggtgtcggcgcgtctggcaaccatcggcccagcgcctggtatgccgccgattattgcgcctggccgatggccagtctggaatctcccgaactgacgttgcctgcgacattaagccctggcctcgacttttctcgcagggaggcggtatgacggcgcatgaagttaattttgacgggctggtggggcttacgcaccattatgccgggctatccttcggcaatgaggcatcgacccgccaccgttttcaggtgtcgaatcctcgtctggcggtaaagcaggggctgctaaagatgaaagctctggcggatgccggctttccccaggcggtgatcccgccgcatgagcggccctttattccggcgttacgtcagctcggcttcacgggtagcgatgagcagattctggataaggttgcgcgtcaggcgccacgctggctttccagcgtgagttccgcgtcgccaatgtgggttgcgaatgcggcgacggtttgcccatcggcagacgcgctggacgggaaagttcacctgacggtggcgaatttaaacaataaatttcatcgcgctcttgaggcgcctgttaccgaagcgctgctacgcgccatatttcgcgatgaaagtcagttttcagtgcatagcgcgttaccgcaggtcgcattattgggagatgaaggcgcggcgaatcataaccgtcttggcggcgagtatggttcggcaggcgtgcagctttttgtctatgggcgcgaagaggagaatgaaatacgacccgctcgttatccggcgcgccagagccgcgaagccagcgaggccgtggcgcgtcttaatcaggtgaatccgcaacaggttatcttcgctcagcaaaacccggaggtcatcgatcaaggcgtattccataatgatgtcatcgccgtttcgaatcgacaggtattgttttgtcacgaagcggcgtttgcccggcagaaagtgctcattaatcagttgcgtacgcgcgttgacggttttatggcgatagaggtgcccgccggagaggtttctgtatcagatgctgtggccacctacctgtttaatagtcagttgttaagccgtgacgacggctcaatgctgttagtgttgccgcgggaatgtcaggaccatgccggcgtctggcgctatctgaataagctggtggcggaggataaccccatcagcgcgatgcaggtgtttgatttgcgagaaagtatggccaacggcggcggcccggcctgtctgcgattacgcgtggtgttaacagaagaagaacgacgggcggtgaatccagcggtaatgatgaatgacgctctgtttacggcccttaacgcgtgggcggatcgttattatcgcgatcgcctgaccgctgccgatctggccgatccgttattattgcgagaaggccgggaggcgctggatgtgttaacgcgtctgctggatttggggtcggtttatcctttccagcaaacgggggcggctgatggataactttctggcgttgacgctaagcggcacgacaccacgggtgacgcaggggaagggcgcgggttttcgctggcgctggttaggccatggtctgcttgaactcacgcccgatgcgccggtcgaccgcgcgttaattctttctgcggggatacacggtaatgaaaccgcgccggtcgagatgctggataagctgctgtcggcgctgtattcaggcagcttgacgttaacgtggcgagtgctggtggtactcggcaatccgcaggcgctggcggcgggaatacgctattgtcacagtgatatgaaccgtatgtttggcgggcgttggcagtcctttgccgaaagcgatgaaacgcggcgggcgcgtgagctggagctaagtctggagaccttcttttcatctggccaggcgcgggtacgctggcatctggatctgcataccgccattcgtggctcgcatcatttgcgttttggcgtattgccgcagcgcgaccgcccgtgggaggcggattttctggcgtggctgggcgcggcaggactggaggcgttggtatttcatcaggcgcccggcggtacgtttacgcactttagctctgaacatttcggcgcgctttcctgtacgctggagttgggaaaggcgttgccgtttgggcaaaacgatctgacgcagttcagcgtaacctcgcaggcgttgtcggcgttgctgagcggtgtcgaaacgtcaacctcgttttcgccgccgctacgctatcgggtggtgtcgcaaatcacgcgtcacagcgacaagttcgcgctttatatggatgcgcaaacgctgaattttactgcctttgcgaagggaacgttgctggccgaggagggggataagcgcgtgacggtgacgcatgacgttgaatatgttctctttcctaattcctctgtcgcctgcggattgcgggctggattaatgctggaaagactgccctgataaatgtccctgtaagctcacgttaggattacagggatgatttgggacacagtttcatgctattacggattattcctagagaattgctttattaataagcgttgctgcgttatagttctgcataatttctgctatatcatgctgttgtatatttctctttcaactctgcgcaatttattctttttttcttcacaattggcgaaaaagtgttttttatactttcattgttttaccgttgttctgactaattgacgctaagacggttaaagttaatcacgacaacacggcgctgttttaaatatgccgtaaaaataactgaaaggaaggatggaaatatgcgtaaactgactgctctatttgttgcctctaccctggcgatgggtgctgcgaatctggctcatgccgctgagactaccaccgccgcgccagcggatgcgaagccaatgatgcagcataaaggtaaatttggcccacatcacgatatgatgtttaaaaacctgaacctgacagacgcgcagaagcaacaaattcgcgacattataaaagcgcagcgcgagcaaatggaacgtccgctgctggaagagcgtcgcgccatgcatgatattattgccagcgataccttcgataaagccaaagccgaagcgcaaattacgaaaatggaagcacagcgcaaggccaatatgctggcgcatatggaaacccagaataaaatttataacgttctgacgccggagcagaaaaagcaatataacgctaattttgagaagcgtctgacagaacgcccggcgcaagaaggtaaaatgcctgctgcggcagaataactttccgcataatttaagaccgccggtcttgtcgacaacacaatcgttgaggtggacaggatcggcggttttctttatgactggcgacagtcggtgtgcagttcaatgatctcatattgacctgacattagtggcttacagagaattttatagccatcctgatcaaagcccgcaggggtgcgcaccagggtggcggcctcatccagcgagggtaccgcccccagccataaccagttgttgataatgtggaactgggtcatttgtgggcggctctcttttaacgcgatagcgcctttccagggccagcaaaccacacgtaaccgttccagtgaggcctgcagacgaagaaaatgcgcctgcggggtttcttgcccacaacacgcgccagcgcagcgcttcagcgcgaaacgaaaacaggcgcgcccacggcttaccggttcaagccccagcaggccataacacaatttttgttcatcggcgaggttctgtaagctttgcagcgctgcccgacggttggcgaagagtccaaacaggttcggctcatgggaaaaatcgacgctgcgggcggaaacgacctcaatcttttgttcgctcaactgtagagagcaaagctggcgattacgacgtaaccgcttgttaaacagcggctgttgttctttgatcagtcgcgcctccagcagcaacgcgcccatttccccagcggtgcagatccagcttatccgccgcgcctgtcgcagcatagcggcctcgtcaggcgttcgcagatgtgagagcacccggctgcgaatatttacgcttttaccgatataaagcggcagcgtatcgctttcgctatgaaatatatagacgcccggtaaggctggcgcttcgctgaggaaaggacgtaaatgttctggatattcgtaaatggccgctgcttcaaactcaaggcggggggctgattgacgccgtaccacagtgatctccgttaactggttattcatccagtataacagcggatgggtgattaaaaaagaggctgggaagagaggaggccggatagacgagcgatatccggcacaacagtagaagtacgcttactttttccaaaagtcgtcgaataccgtaatcggtaaacggcgcttatgttcagtttttacgtaccagccttcgatagttttagcgatggcggagtccagcgttttgccttccaggtaatcgtcaatattgtcatacgttacgcccagcgcggcttcatcaggcagtgaagggcggtcgtcttccaaatcggcggtggggacttttttatacagatgctcaggacagcccagcgctgcgagaagctgtttgccctggcgtttgttaaggcgatgaagcgggttaatatcggtaccgccatcgccatatttggtgaagaacccggttatcgcttccgccgcatggtcggtgcccaccacgacgccgtgagtcataccggcgatgctatattgcgctttcattcgctcacgcgctttttcattgccgcgaacaaaatcgctcagctcaattcccgcttcgcgcagcgcctgttcgctggcgaggacggcgcctttaatattgacggtgagtactctgtccggctgaataaaagcaatggcgtcctggcaatcctgttcatcggcctgcacgccataaggcagacgaacggcgataaactgcagcgcattatcaccggtctcttcccgcaattcggtgatagccatctggctgagtttcccggccagcgtcgaatcctgcccgccgctgatgcctaacaccagcgatttcaaaaagggataggttttcaggtacgctttaagaaaatccacgctgcggcgaatttcttcttcagggttgatatgcggtttcgcgccaagcgcctggattatctcttgctgcagagtcatttaacccccttcgacattaaaaaatgaatctttaccctgttaaagctaacccttcgccgctgaaacgacaaggtttggcgggctaagcggtgtttaaaacaacatatcgctgcgttagagaattttccgaaagactttttgtcgcgaggcgcggcttgaaaaatgttctgatgtattccaggcttacataacacgctgataaacaagaggacggaaaatgaacaagaacgtagcaggaattttaagcgcagcggcggtaatgactatgctggcaggctgtacggcgtatgatcgtacaaaagaccaatttgttgagcctgtcgttaaagatgttaaaaaaggaatgagcagggcgcaagttgcgcagattgcgggcaaaccgtcatctgaagtgagcatgattcatgcgcgtggtacctgtcagacctacatcctgggtcaacgtgatggtaaagcggaaacctactttgttgcgctggatgataccgggcacgtgattaactccggctaccagacctgtgcggagtacgacactgacccacaggcgccgaagcagtaacaactgtacattgcctgaacattcaaggaaaccggcctgcgagccggtttttttgtgcctgccataaccttatttattatcgcgaattatttgcccgaaatgtgaggggggtcataacgccaggtcaatgagagacaatttagtaggtcaaggaaataccatccggcggtccgatcccgtatactcatttcagccacctaaaaaagtaaatccggttacgcaagtcgcccagagtatggatgcaggttgaggcttgcggcgtatctggttgacagataatcgcacatgaggaaggtttttatggaaaagaaacacatttatctgttttgttctgcgggcatgtcaacatcgttactggtatcaaaaatgcgcgctcaggctgaaaaatatgaagtgccggtgattattgaagcattccctgaaaccctggccggtgaaaaaggcccggcagcggacgtcgtgttattaggcccgcaaattgcttatatgctccccgaaattcagcgtttattacccggtaaaccggtagaagtcattgattcaatgttgtacggcaaggtagatggcttaggcgtgcttaaagctgcggtagcggcaattaaaaaagccgccgcgaattaattattttttaatttttcccgtcaaagagttatttcatacactaaccgcaatattttattgcggtatttaagggtatttttctatgagtaacgttattgcttcacttgaaaaggtactccttccttttgctgtaaaaataggaaagcagccacacgttaatgcaatcaagaacggctttattcgtttaatgccattaacccttgcgggggcgatgtttgtattaattaataacgttttcctgagctttggggagggggcgtttttttattccatgggcattcggcttgatgcctcaaccattgaaacacttaatggattgaaaggcatcggcgggaacgtctataacggcacattgggcattatgtcgctcatggcgccattttttatcggcatggcgctggcggaagagcgcaaggttgatgcgctggccgccggactgctctccgtggcggcatttatgaccgtaacgccgtatagtgtcggcgaggcctatgccgtaggcgctaactggctgggcggcgcgaatattatctccggtattattattggcctggtggtcgcggagatgtttacatttattgtccggcgcaactgggtgattaaactaccggacagcgtaccggcttcggtgtctcgttcattctcagcattaattcccggctttattattctctctattatggggattattgcctgggcgctgtctaattacggttctaacttccatcagattattatggacactatctctacgccgctggcatcgctgggtagcgtggtagggtgggcatatgtcatttttgtaccgctgctgtggttctttggtattcatggttcgctggcgctgaccgcgctggacagcggcatcatgacgccctgggcgctggaaaacatctctatttaccagcagtatggctccgtcgatgcggcgctggaagccggtaaaacgttccatatctgggcgaaaccgatgctggattcttatatcttcctcggtggtagcggcgcaacgctgggtctgatcatcgctatcttcctggcatcccgtcgcgcggactatcgccaggtggcaaaactggcgctgccgtcaggtatcttccagattaacgaacccatcctgtttggcctgccgattattatgaacccggtgatgtttatccccttcattctggttcagccgattctggcggcgattacgctggtggcttactatttgggtattattccgccgattaccaatattgcgccgtggaccatgccaaccgggctgggggcgttctttaacaccaacggcagtgtcgccgcgttgctggttgcgctatttaacctggcggtcgctaccctgatttatctccccttcgtggtggtggctaacaaagcgcagaacgccatcgagcaggaagaaagcgaagaagatatcgctaacgcactgaaattctaaactccgcgtcggcatgggatgccatgccgggctgaatcagaggaaagactatgtttgatcttgaaaatgttgtagataaccagacagcggctgaggaactcgaagaagtcgttatggggcttatcatcaattctggtcaggcgcgcagcctggcatatggcgcgctcagaaaagcgaaagaaggcgactttgaggcggcgaaagcgatgatggaccagtcgcgcatagcgctcaatgaagcgcatcttgtgcagacaaaactcatcgaaggcgatcagggcgaaggcaaaatgaaagtcagtctggtcctggttcacgctcaggatcatttgatggcctcaatgctggctcgtgaactgatcgctgagttgattgagctccatgagaaactgaaataacagggggcggatgatgcagctacaggttaacgcaacggaaatcaaaacggtttatgagcagcagctcttcaatggcaaaaatttccatgtgtttatctataacaagacggaaagcgtcaccgggctgcatcagcacgactattatgaatttaccctggtattaaccggacgttattaccaggagattaacgggaagcgtgtgctgctggaacgtggagattttgtttttatcccggtggggtcgaatcaccaaagtttctatgagtttggcgcaacgcgtattctgaacgtaggaattagtaaacgtttttttgaacagcattatcttccgttactgccgttttgttttgtggcatcgcaggtatacagggcgaatagcaccttccttacctatattgaaacggtgattgcgtcgttgaattttcgcggcaatgggctcgacgaatttatcgaagtggtgacattttatattataaaccgcttacgtcattaccgcgaagagcaggtttatgatgatattccacaatggctgaaagcaaccgtggagataatgcatgataaaacgcagtttggcgaacatgcgctggaaaatatggtgcgcctgtcggcaaaatcccaggagtatctgacgcgcgccacccgacgttattacagcaaaacgccgatgcaaatcattaatgagattcgcattaattttgccaagaaacagttggaaatgaccaactattcggttacggatattgcttatgaagccgggtacagtagtccaagtctgtttattaaaacgtttaagaagatgacctcattcacgccgaatagttatcggaagcgattgacggaaattaatgagtaacggtttacattgctcgattagttacatttcacgcttgccccaatagcgcggggaacgtcacgctatttcttacgagcgggcatagcgtaatacatatcagtgtcatacactgaagggagatattatgagccagaaattaaaagtcgtcactattggtggcgggagcagctacacccctgaattacttgaaggctttattaagcgctaccatgaattacctgtcaccgaattatggctggttgacgttgaagacgggaaaaagaagctgggcattatttatgatctctgccagcgaatgattgataaagcaggcgttccgctaaaattgtataaaacgctggatcgccgggaagcgctgaaaggcgctaattttgtcactacccagctacgcgttggtcaactcaaagcccgtgagctggacgagcgtatcccgcttagccacggctatctggggcaagaaaccaacggcgctggcggtttatttaaagggttgcgtaccattccggttatttttgacatcattaaggatgttgaagaattatgtccgaatgcgtgggtcattaactttactaacccggcggggatggtgacggaagcggtttatcgtcataccaactttaaaaaattcatcggcgtatgtaatattcctgtcgacatgaaaatgtttattcatgacgtgctggcgctgaatgagaatgacgatctttccattgacctgtttggtctaaaccatatggtctttattaaagatgtgctggtgaatggcacctcacggttcgcagaattactggatggcgtggcgtccggtcagttgaaagcgtcaaccgtaaaaaatatctttgatctgccgtttagtgaaggattgattcgctcgctgaacatgctgccgtgctcttatttgttgtattacttcaagcaaaaagagatgctggcgattgaaatgggcgaatattacaaaggcggcgcgcgcgctcaggtcgtacaaaaagtggagaaacaactcttcgacttgtacaaaaatcctgagctaaacgtgaagccgaaagagcttgagcaacgcggcggcgcttattattccgatgccgcttgtgaagtcattaacgctatttataatgacaagcagactgagcattatgttaatattccacatcatgggcatgtcgagaatatcccggcggactgggcggtggaaatgacctgcattctgggacgcaatggcgcgacgccgcacccgcgtatcacccgttttgacgaaaaagtgctggggcttatccacactattaaaggatttgaggtcgcggccagcaatgcggcgctgagcggaaactttaatgatgtgctgctggcgcttaacctgagtccgctggtgcattccgaccgagacgcagaagtcctggcgcgtgagctcattctggcgcatgaaaaatggctgcctaattttgccgcttgcatcgaagcgcttaaaggtaagcaccactgacagaggtaggctatggaacgcgtgttgattgtgaatgccgatgattttggcctgagtaaagggcaaaattacggcattgttgaagcatatcgcaacggcgttgtgacctccacgacggcgctggtcaatggcgaggctattgaccatgcggcgcagcttagccgcgagctgcctgcgcttggggtgggaatgcattttgttttgacgttaggcaaaccggtgtcagagatgccgggcctgacgcgagacggcctgttggggaaatggatctggcaaatggcggaggaggatacgcttccgctggatgaaattgcgcatgaactggcgtgtcagtatcagcgtttcatcgacgtatttggccgcgagccaacgcatctcgacagtcatcatcatgtgcatatgttcccgcaaattttccccatcgtcgcccgctttgcggcgcagcgcgggattgcgttacgtattgaccgccagacggtgttgaatgcagacgatctgccgtcggatttgcgcagcactcaaggatttagtagtgaattttacggcgaggagatcaccgaagcgtgctttttacgcattctggatgcctcggcgcatcgaggagaagcctctctggaggtgatgtgtcatccggcgtttgtggacaacattattcgccagagcgcctattgttacccccgcttaactgaactggaggtgttgacgtctgcgtcactcaaggcagggattgcggaacgtgtatatcgtcctggcagttttcttgatatttagctcctgagtttgcggcgcaagaatgcgccgcattttttgtctatggaaaacccccagctaggctgggggttccggaaagctttcagctttaagccagttattaaaaccccttttgatttgttaaaacatcttgcggtctggcgactgcaaaagttcaacaagaaatcaaaagggggtcccaatgggggacgaaaagagcttagcgcacacccgatggaactgtaaatatcacatagttttcgcgcccaaataccgaagacaagcgttctatggagagaagcgtagggcagtaggcagcatattaagaaaattgtgtgaatggaaaaacgtacgaattctggaagcggaatgttgtgcagatcatattcacatgcttctggagatcccgccgaagatgagtgtgtcgagtttcatgggatatctgaagggtaaaagtagtctgatgctttacgagcagtttggggatctaaaattcaaatacaggaacagggagttctggtgcagagggtactatgtcgatacggtgggtaagaatacggcgaagatacaggactacataaagcaccagcttgaagaggataaaatgggtgagcaattatcgatcccgtatccgggcagcccgtttacgggccgtaagtaacgaagtttgatgcaaatgtcagatcgtatgcgcctgttagggcgcggctggtaagagagccttacaggcgcatcagaaaaacctccggctatgccggaggatatttattttgccgtttatgcaggaatcgcgttaattttccccgcacgcgaccagacacggtgtgccgccatcagcgtcagcagagtgtccataaagtggtggtcaacgttatctgcctcaacaagtccttcttccccctggctatcaatgtttaaaagcgccttaaaccgtcgggcgtcgcctgccagtgcgatgggcttcagatgtttgtaggcttccagaaggtagtaacgggcatcgccgcaactctcgatatcggcaatattgccgcacggtactattaccgcatcgaccgttagcgacggcgcgccggcaaaggttgccgcaatagttaatgttgaaccgtcatcagccgttacttcccccatccgtgaatagagcagttttacgtggacgcctttggcttttaaagcctgaaaaatggtcaacagttcggcggcgttaaccttgtcgttcagcagaatagcgaccactcggcctttaacatcgccgtccggcaccgcatacaggctgagcgccggatcttttttcagaccgttgacatcaggaggcggggcaatttgcgtttgctcatgggtgagtgcaaaaccgagattatgcgcgacgccctgagccagcgtgacatcaatatgcgctaactgatcgaccacccgctcccgaatatacgcgcgggcgactttacccagctcaaagctgaacgcgtcaataatatgctgctgttctatcggcgtctgactgagccagaacaggcgaggatgcgagtaatattcaccgaaagaggggctgcgttcgcggatttcattaccatccacgcgttcctggtatgattcgaagccgccgcgttttggcgctggcggcgtttcgcgtggccagttgtcattaatggagtttggttcatagttcgccggattggtgtcgatatccatccggtgcataccgtcacgctggaagttatggtaggggcaggtagggcggttaatcggaatttcgtggaagtttggcccgcccagacgactgatttgcgtgtcggtataagagaacagacgcccctgtaacagcggatcgttggtaaaatcaatgccgggaacaatatgtcctggatgaaatgccgcctgttcgttttcagcgaaaaagttatccggattacggtttaacaccattttgccgacgcgttgtactggcaccaactcttccggaatcagtttggtcggatcgagcagatcaaaatcgaatttaaattcatcctcttcggcaatgagttgtaggcccagctcgtattccgggaaatcgcccgcttcgatggcctcccacagatcccggcggtgaaaatccggatcgcgaccggtcagtttttgtgactcatcccataccagcgaggctttacctgccaacggtttccagtggaaacggacaaaggtcgctttcccttgtgcattgatcagacggaaggtgtgaatgccgaacccttccatcgtccgataactccgtggaataccgcgatccgatattgcccacatgacgttgtgcagcgtctcaggctgtaaggaaacatagtcccagaaggtgtcgtgcgcgctctgcccttgcggaatagcccaatgtggttcgggcttaacggcgtgcacaaaatccggaaacttatgcgcatcctggataaaaaagatcggcgtgttattaccgacgagatcgaaaattccctcttcggtataaaatttggtcgcaaaaccgcggatatcacgtacggtatcagcagaccccgcgccgccctgtactgtcgaaaagcgaacaaagaccggggtaattttctgtggatcgcacagaaacgcggctttcgtgatgtcgctcaggtctttatatggctggaaatagccgtgcgctgcagatccgcgggcgtgaacgatcctctccgggatacgctcatggtcaaagtgggtaattttctcgcgcaggataaaatcttccaacagcgtagggccacggctgccggcgcgaagagaattttgatcgtcggcgatgcgcacgccctgattggtggtcagcgcataattttcgctgcctttacgaaaggcgtcgagggcggtgagcttatcattcgcggtctcgggcgcttttaagctgccgggggccgttggttgcgcgcccggcggcgtcggttctggcgtggggcgatgtgaaccgtctgacggtgccagggagtccaggccgggctgtgattcacgggtatcatgcacgggggactgatggggggatttttcattatgcgacattgaactcgtctcctgctttcatcactgaaatgggcgtggtagtagtcaaaatcactctaactatagaacatttcagcaattatgccgggggagagcggaacggcagacagggtacaacggggaaatcgcacgcgcggaacaggacgtcgggggcgaagatcggctaaaatagtgtttttctgatttttagccttagcctcttttagtgaagcattaatgatgaaacctcttcgccagcaaaatcgccagattattagctatattccgcgtgttgaacccgcgccgccggaacatgcgataaaaatggatacgtttcgcgacgtctggatactgcgcggtaaatatgttgcctttgttctgacgggggagtcatttcaacggtcgcccgcctttagcgtgccagaatcggcgcaacgttgggcgaatcaggttcgccaggaaaacgaaatcgctgactaagaaaaaaacaaaacgccggtactggagaccggcgtttttagtgacagacattttgagttgccgatcgtcgtgtctcagacgatgtgaactcccgataatgtattatcgatgcgccagttcagcgtcttcttcgctatcgagaatggttttatcggtctgcttcagccactggctggtcagcgtacccgcggtcattgagccgctcacgttcagtgcggtacggcccatatcaatcaacggttcgacggagattaacagcgcgaccagcgtgaccggtaagcccatggcaggcagcacaatcagcgcggcgaaggtcgcgccgccgccaacgccggcaacacccgccgaacttacggtaacgatacccaccagcgtggctatccatacggggtctaaggggttgatgccgaccgtcggcgcaaccattaccgctaacatcgcaggataaagaccggcacaaccgttttggccgatggtcgcgccaaaagaggcagcaaagctggcgatggactccggcacgcccagacggcgggtttgcgcttcgacattaagtggaatggaggcggcgctggagcggctggtaaaggcaaatgtcagcaccggccacaccttgcggaaatatttcagcgggctaatcccgttcacgcccaatagtatgccgtgaaccacaaacattatcgccagaccaagatatgacgctaccacgaagcttccaagcttaatgatgtcctgcaaattagagccggcaaccactttcgtcatcagcgccagtacgccgtaaggcgtaagttgcatcaccagacgcaccagcttcatcacccagctttgcagggtatcgatagcaacaagcacacgctcgccttttggcgcatcatctttcagcagtttaagcgcggccacgcccaggaatgcggcgaaaatcaccacgctgataatagacgtaggatttgcgccagtcagatccgcaaacggatttttcggtacaaaagacagcaccagttgcggcacgctgagatcggccactttgccgacatagctcgtctcaatggcattcagacgcgcggtttccgcgccgccctgaaccagaccttccgccgtcagtccgaacagattggtgaccagcacgcccaccagcgctgcgataaaggtagtaaacagcagcgtgccgatagtcagaaaactgattttccccaattgagaggcgttatgcagtcgtgccacggcgcttaaaatagaggcgaataccagcggcatcacaatcatttgtagcaattgcacataaccgttgccgacaatattgaaccactgaatggagtcttttaacacctgactgtcagcgccataaatggtgtgcagggccagaccaaagaccacgcccatcacaaggccgacaagcacttttttagccagactccactgtttatgacgggcctgcgccagtacaaacagcagaatgacgaacaccgcaatgttcgcaattaatggaaaattcatccccgttctcctgatttttttattatgaagcgctgtgttttagcgattctgttcgcgcaagattagcagaactgtgagctggctcttatattcaaatggaatggtttatacctaaaatgactttggcgttgatttactaatcaatctggtgatttataaaacgattgaactgcatttgcaggatagtgatcatctgcgaagaccagcgtatgacgttgttttccggcatggattgcggcatccacaccgcccaggcaaacaacgccatacataaaaatcgctccagttgattgcccttgcgcggcgccagaataggcaggcggaaacgccagcgacacggccacagtaagggaacgcctgcgggggtaagcatatccgcgacgatatggcttaaatagccgagtaccatgccttgcagcgcatccgccgggataatccacgtatccggaaccttgagataaaaggtcgccagtagggcaaagaccgccagcagactatgggtaaacccccggtgaccgaatgcgcgggcgatcggtttcgatacccatttcaggcgctgaccaagaaaagatttggggtgatcgatatccggcagcagacaggtcaaaatagccgaaggaataatatgccaccagtcgccgtgcgcaagggcgggcgttaactcggcattcttggcgaaaaccgcgctggctatagaaaaaagaagatgtccttccgccgtcatgataaaacccattaaactgtcaattcatacagtatagggtttttatacagtaggcggaagtggtgacgttgtaactctttgtctctgtcaaagccgcttgccgtctggctcagcggctaattgcccgttgactttgtttcggaaacatcttaaccgagtagatgcgccgccgtcagctctgtcagtgagttaagtttgacattcgccagcgcaaagcgcggatcatgctggttttcttctgctggcaccacaatggcgcgcattcgcgccgcctttgccgcgattaaaccattcaccgaatcctccagcgccacgcaggttaatggatcaacgcctaatttggccgcacaatccagatagacctgcgggtgcggtttgctgtagggcaatttttccgcagaggccagcgcgtcaaaactgtcgcgcagttcaaacatggtgagcactttttccagcatatgcagcggcgatgccgaggcaagccccactaatagcccctgcgctttacacagcgccacagcttcgcgcacacccggcaaaagagggcgcgtctcttcgataagcgtaatcgcgcgggcaataacacggtttgtcacttcctggcgatcggggccgttccacggttgctgcgcaaaccagagatcgacaaccatatcaatgcgtagcctaagcgtgtctggcagttcatggcgccgagtaatatctacgcctaaacttgccatcacgtccagttcagcgcgatcccagagcggttcggaatcgatcaatagtccatccatatcgaaaattgcagcaagaatttgacgtggggttgacatcacaacctctcctgttgagattaaaaaataacgaattaagcgttcattatgaccatgttcttagtatatcgcccttaaagatcaggcgaaaacgggaatcaacaggtagacttaggccaaaacgacgcgtctttatcaaggggaactcatgacgtatcaacaagctggacgcattgcaatcctaaaaagagttgttgggtgggttatttttattccggcactgctttccacgctcatctcagtccttaaatttatgtatgcgcacagtgaaaagcaggaggggataaatgcggtaatgctggattttacccacgtaatgatagacatgatgcgcgtgaatacgccgtttctgaatgttttttggtacaactcgccgacgccgaattttcagggaagcctgaatatcggtttctggctcatttttattctgatttttgtcgggctggcgatgcaggattccggcgccagaatgagccgccagtcacgttttttacgtgaaggcgtggaagatcagttgatcctggaaaaagcaaaaggcgcggaaggactaacgcgtgagcagatagagtcacgtatcgtggtgccgcaccataccatctttttacagtttttcccgctctatattttgccggtcattattatcgtgctcggctactttttcttttccttgttaggtttcatgtaaactgaaaaatgccggatagcccgtatccggtgtgggctgtacctataccgcaagcagccgatccatcgctttttgcgcagtagccaggtgctgaccgccaaacagccttgcccgattaagcagggtgtagagctggtaaatcggctgcctgtcgagaaaatccagcggtagcggcgaaacggactgatagccgtcataaatctgcggtggctgatcggtatgcagcggcagcatcgccagatcgcattctctgtcgccccaatagcaggctggatcgaagatataggggccgtcagggccaagcgcgcagttcgccgaccatagatcgccatgcaaaagagaaggctgcggttgatgcgacgccagacgttgctgaacatgttcaacaatggcgtcaatattaccaaaggtaatgcctttttccgcggcgagttcaagctgccagccaatgcgctgttcggcgaaaaaagtcgaccaacggcgttgccaggtattcggctgcggcgtggtagagagcgcgttatcaaaatcgaggccgaattgaggttggtcgctccattggtgcaggcgcgccagctgttgcccaagaataaacgcattatgggcatccagcgggcggggcgagaggtagtccatgactaaaaagctgtaatcccgatccgaacctaccgcccataccttaggcacaacaacggttttactgcgggagagcagctccagctgatcggcttcagcggtaaaaccgcgaagcatttctcgttcatcgcacttcacgaaaaaatcatggccggcataacgtaaatgccatgcggcatgaacttctccgcctggcagttcattacgcagttcgatttcgccttcaccgacttgctcgcttaaaagacgactgatagcttgccacataatgtctctccccacgttgtctgccagatcataaggttagcgcaaaaatgcggttaaaaaatacgaactaacgcacatcgcggacgcgccgcggcgggaatggcacttattgtgcgtttttactccacgcctcccaggtcgccacggtaatgtcgacatccttatctaacgcgcttttcgcaagtccggcgacaagcgctttgatttcatcagcgctctgagcgctaacaaagccaaacgtattggtgccgagctcatgcacattcccttcatcgtccgttaatgtcagcaaaaaaccgctgcgcgtcagatggttattgagttcgttaatctcggtcagggaatcttcatggaaggttacggtaataacataacgggtaatatcgccactggccatcgttcacctcgttgggagcaactgtgtttttaacagcggcggatgcgccgcccgttaaccgattttccggtatccccctcggcgagggggaaacgattattgcgcggaaagataggcgtatattttttgggtatcgtcatgagaacacagacgcgtaccttgattgagcgtagcggcgctgcctgccgccacaccgaagcgcaccatctcttccagcgacgcgtcttgcgccagttttaacgtcatcgcgcccaccatactgtcgcctgcgccgacagtactttgacttttcaccgggggaggaacaacctggatgcaattctcactgtctatgcccagcgccccttgcggccccagagagaccactacccggcgagccttgccactttgcactaattcctgggccgctttacgcacatcatcaggctgcgtcagatcgcgattgactaacgcgctcaattctttcaggttaggtttcaccagttcgatatcgccaagcgccaacgcagcggtgagcgcgtcgccagagctatcaataatgcagcgaatgccttgcttctgcgcggcggaaatcagttgcgtgagtttctcgaccttaacgccgggcggaaggctgccgctgataaccagaattgccccggattcaatttccagtacctgttcttcaagctggcgaaattcgtcatcgtccagcgtggcgccgggcataacaaaacgatattgttcgccgctggactcgacgtggacgtgcaggttctgacgcgtccagtccttcgcatcgacggtagacacggggacattttcgtcagccagtagtgcgaccagatgttcgccggtagcgccgccagccgggaaaattgcggtcgcggtgccgccaagatgcgcaatggcgcgagcgacattaatacccccgccgccgggttcgaataccggcgcggagcaccgcagtttaccttcgggataaatttgcggcgtgattgttgcgctatcgagagagggcgcaagcgtcaacgtatagatacgtaccatcgttacctcctgttaggctgatttcagtctggcacttaatccccggaaagtgaaggaattaacaatatgattttccggatctttatttaaagaagtacgatgtaaagttatataaataaatgaatgcttcgggagggttcttattcaaaaaatgaaatagtaattgattgctatgttattcggggcttcttataattcgctacctttccaggggcgtttgtcattgatccctatgaaagtttccgggaccgtcgtggtctcttttttagttgtacggactctatataaatgaagcttttgaaggcagtacccgctgtagttatgctggcgggtggcgtgttcgcgtctctgtatgccgccgccgatgattccgtttttactgtcatggatgatccctccaccgcgaaaaaaccttttgaaggtaatctgaatgcgggctaccttgctcagtcaggcaatactaaaagttcttccttaacggctgacacggcgatgacctggtatggacaacgtaccgcctggtcattatggggcaatgccagcaatacctcctctaatgatgaacgctcttcagaaaaatatgcggtaggcgtgcgtaaccgttttaatatgacggattatgattatacctttggccaggccagttggctgacagaccgtttcaacggttatcgtcagcgcgacgtactgaccgccggttacgggcggcagttccttaatggtccagtgcacagcttccgttttgaattcggtccaggggttcgctatgacgaacatacggacgataccactgaaacgcagccgttgggttatgcttccggcagctatgcctggcagttaactgacaatgctaagtttacacagggggtgtcagtatttggcgcagaagacaccacactaaattcggaaacagccctcaatgtcgccattaacgaacattttggtctaaaggtggggtataatttaacgtggaactcgcagccgcctgaatcagcgcctgaacataccgatcgccgcactacggtaacgctgggctataagatgtaatattgcgccgggttacgttacgtaacccggttattccgtggtgacgcctcagaagaagaaggtgatgtcgccgttgatataagaatagtcgtctccggtgcgaaattccgacgtgactttgtttaaagaaagagaaaatgcgacgggagaatagccgatggtggcaccgacgcgatattcatccacggttttattaatatccaccgtttccatttttgtttgcagcgttttcccctgtaacgtgtagtttttatcaacttccctgcgctcaacgccagcaaatactttatagatcaatccctctttttgagtgtgtattaaccctcggcgggacaataacccaaacccattatcagagttgaaggtcttatcatttcccagcgcaacggttgcgccgtaccccaaatactggaagagattgccgccgacagcagagacttctggatagaagcccacattgacacccagaatatcaatagctggcgtaagggagaccattccttttgccgtgtaaccataacggttttcaatttgatcctgccaggcagggtatttttctgcgcctattattcgatgcgcccgattctgaacctcctgaccgcctgcgtcaggaccaataacgccgatatcggtacctaaacgataacgtaaccaattggtggctaatgaattccactccagtccggtatgaagaaaggcgctgaacgcgcggtcgcctttgacggcttcaggctttcttttattggcgccagatggagaataaatatcttgcgcgatatgaaaagagagttgactggcgtcagtgagatcgtggctgtagcctaaaaagagcccggcagtataatcaccccggtctgcagccttgtgcccgtaaagggcatttaaggatggttgaaatatacctgcatcatcattcgccactgaaatagcaaggctactggcattggccattgtggtcgtactgagtatggcggcaatcatcgttgcgcaatagctgtatttgttcactttttacccctgaatatgaaagtgaatactcttatttttacaaagtaataagcacagcagcatgatgcgcagtgcttattaaacctttaaatataactaaactcctgccagcagcgagtcattgagaggatacgttgccttaatgttgaaaaatggtgttaaaaaacatgcgccagatattattgaatatccatttttcattcgctatctgagtgcgagaaattattggcttcacgattatgcatataatacgatgttttttggtatcaacatgaatatcatgttgtattcttttgagctcattttctttgatggcttcgatgtttatctgttattaatttttaccgtgatagtgttgtctttaatgatgagcgcatctaacggctggcagggtaatataaccaaattattgccatctgaattattagggcagttattattaaggaagaaaaaatgaataaaaccattaatctgctaaaattactgcccgtagtattattaagcgcatgtactacatcgtatcctccccaggatacaacatcggcacccgagttaccccatcgtaacgtactcgttcagcaacctgataactgtagcgttggctgtcctcaaggaggaagtcaacaaacaatctatcgccatgtctatacgctcaataataatagcgccacgaaatttgccaactgggttgcctatagcgtgacaaagaccagccaggcaagcggtcgcccgcggaactgggcgcaggaccccgatttaccgccctcggatacgttggccccttcggcctataaaaatgcccatacgctattaaaagtcgacaggggacaccaggcgccgttggcaggattgggcggcgtttcggactggccgtcgttaaattatttatcgaatattacgccgcagaaatccgccctgaaccagggagcatgggctgcactggaaaaccgggtgcgcgaacttgccaaacaggctgatgtatctgtagtgcacgtagtgaccggcccccctttttgagcggcatatcgccacattgccagaagatgcgacggtagaaattcccagcgggtactagaaggttttattcaccggaacggcgccgtcaaaaagtgaaggaaattacgctgcgtttattatggatcagaatacaccccgttcggcgaatttttgcgactatcaggttaccgtggaggctatcgaacataaaacgaagccagtgctgacgctgtggtctaacttgcctgaagcggtagccagcgaggtgaaaacaacaaaggggagtctggcgcagaggttaggttgccgatgagaagcgctatacggcgcgtagaaagataatggagaaaccctgtcaaggggcttgatttgctacagagtgatgcaatccccctttttttagtgttaccatcatcatgccggacgaaaatagcgattttcgtctgtgtcgaaggttgtgcgccaatttagcaatggttggctagatggatacacaactcactgttaataaattcattttctctttgtatgtgatcttgcgtaataagtacaatcctttattcacatccattctcgttcgtttaaacctgtttcaccagttccgcgtcattactggtaatagcggatatatatgtttcataccgttttacattgatccctttcgcgccgtaagatgtacgtacctaatctaacttaagcagggaactgtcattcataacacagagtttattggtatcaatggtagattatattacggtgacaatctcgggatgatccgcatatgagtagatgtggattagggcggagtagcggcaggactaataataaccggcggcgagaaatacataattgaggggctattcataaatcatcatctagaaacgcaagcactatcatgaatatatcataagtaatttacgttggtaatgatggctcagcaaacccaacaagctttacaggaacaatttttacgcttcagagccaaataaaacggcggcattgccgccgtataacttatttattgtttcttagtaaaacgaatcttatatgctctgaaaaaacaaaggaagatgcaatgtataccataaaagcaatcatcaaatgctcagggaacaaccatcccatgctaacaggaatcacacttattccaatgcaaaataggaacattatgaaataatgcgctgactttgtttcctgagttttattggagaaatacttagctaggacgcctttaaatactccagatataactaaccaaactggtgtaaaaagcccgaaatctgcgtatagttcaccatacccgaaagcaggagcgccctgatttctgtagaatgcatcagggaaaaatacttttgccagatacaatgcgccaaaatcttcaggcttatcaggccaaatagccctcggaatcctcgagtaaacctcgctctccattagtaattttccgtacataaagtcaaagtttgaggaagcaacaagaacagcattacgggtataatccgagtaattagccatattttctatcggattcccatcagtaaacgtatatgcaaagaatgccgttacaatgactgctataacagcaaacgattttaccaggaacataaatttaatttttttattttcaatatatgaaaggtaaaggatgaatgctataaatatactaaatattggtcctttgttaccatgcaagaaaataagtatacagttaaataaaactatggaaatacaaaataactttgattttttgtatgtaaagaacgcgcaaatagaagcgacaagagaaaacattaatgaaggatagaagtatataccataccctgttctggttaattcgtatattcttcttgggctaagtatatactctctgaactccatcaacactggaaggtaaatgataaaagcaaggaaggtgaataacaatgaagtaaacacataccttggtttatttttcgtgtttgatttgttgtatatgggttttctttgtgtgtaaagataagaaataacaaatgatgctatgtatgttatatagcaagtatagaaaaacaaatattccactgtataattctgcacctctgagaggtatacaaatataccttcaaacacgtacagtgtagggactgttattatcaggtatgggaccattacatttattatttttccctcaattcttacggaaagagtatagagataaactataaataataagcataatgcaatgtatgaaattataagcatatagagcctttagaaaaaatgcttagtattaaaaatattaccatcaggcaaataaggtgtggtacggaaaatcttctggcaagatattctgaatctggtagtctataatcattactcatcactatcttcccgatatcaaaaccgtgttattgaaatattaacactcattaacactcctatctactgcgcctccgatagcatgaagctatcaagcgtttgcagcacaaacatcaaacaatgtaaatgcttttgataattacgcatgattgttactgtgtttatatacagtggcattcgaagattcatcatgaggttcccgagtcctgtaaaagactatacagagaaagagctatcactcgacgagtaattcatctcacatcgtgccgcgacatacttcaagcaacacagacgaattacaagtacggcatcataagtgagacgttgctagttatagaagcttcatagcagcatgtaatggctctttgctggtatgtgctttggaaagtgggtttcgtattgtgcgttatcgcatgctgccaggtccccatctggagaatatagatagcggtcgtcgtgaaaagctatctgatgtgaatgcctcatacggtggcagtaagccgagattcagagtgaccatgtacatcattaacgatacgcgtgccgggtagtgtgttgggattcaggttctgtagaacagaaagatgcaatctccctttttttagtgttaccatcatcatgccggacgaaaatagcgattttcgtctgtgtcgaaggttgtgcgccaatttagcaatggttggctagatggatacacaactcactgtcaataaattcattttctctttgtatgtgatcttgcgtatgggtcaccactgcaaataaggatattacatgcctgttattactcttcctgatggcagccaacgccattatgaccaccctgtaagcccgatggatgttgctctggacattggtcctggcctggcgaaagccaccattgcgggccgtgtgaatggcgagctggttgatgcttccgatctgattgaaaatgatgcgacgctttccatcatcaccgcaaaagatgaagagggtctggagatcattcgtcactcttgcgcgcatctgttaggtcacgctatcaagcaactttggccgcacacgaaaatggcgatcggtccggttgtcgacaacggtttttactatgacgttgatcttgaccgcacgctaactcaggaagatgtcgaagcgctcgaaaagcggatgcatgagctcgccgagaaaaattacgacgttatcaagaagaaagtcagctggcacgaagcgcgtgaaaccttcgtgaagcgtggtgaaagctacaaagtttccattcttgatgaaaacattgctcatgatgacaagccaggcttgtaccatcatgaagaatatgtcgacatgtgtcgtggtccgcacgtgccgaatatgcgtttctgccatcactttaaactgatgaaaactgccggcgcatactggcgcggtgacagcaataataagatgttgcagcgtatttacggtacggcatgggcagataaaaaagccctgaacgcttatctgcagcgcctggaagaggccgcaaaacgcgaccaccgtaaaattggtaagcagctcgacctgtatcatatgcaggaagaagcgccgggcatggtgttctggcataacgacggctggactatcttccgcgagctggaggtctttgttcgttctaaactcaaagagtaccagtatcaagaagttaaaggcccgttcatgatggaccgtgtgctgtgggaaaaaaccgggcactgggacaactataaagatgcgatgttcaccacatcttcagaaaaccgcgaatattgcatcaagccgatgaactgcccgggccacgttcagatctttaaccagggtctgaaatcctatcgtgatttgccgctgcgtatggcggaattcggtagctgccaccgtaacgagccatcaggcgcgctgcatggtctgatgcgcgtacgcggctttacgcaggatgatgcgcatatcttctgcaccgaagagcagatccgcgatgaagttaacgcttgtattcgtatggtctacgatatgtacagcacctttggcttcgagaagatcgtcgtcaaactttccactcgtcctgataagcgtatcggcagcgatgagatgtgggatcgtgctgaggcggatctggcggttgcgctggaagaaaataatatcccgtttgagtatcaactgggtgaaggcgcattctacggtccgaaaattgaatttaccttatatgactgcctcgatcgtgcatggcagtgcggtacagtacagctggacttctccttaccgtctcgtctgagcgcctcctatgtaggcgaagacaacgagcgcaaggtgccggtaatgattcaccgtgcgattcttgggtcgatggaacgcttcatcggtatcctgaccgaagagttcgctggtttcttcccgacatggctcgcgcctgttcaggtagtcgtgatgaatattaccgattcgcagtctgaatacgttaacgaattgacgcagaaactacaaaatgcgggcattcgtgtaaaagcagacttgagaaatgagaagattggctttaaaatccgcgagcacactttacgtcgtgtcccttatatgttggtctgtggtgataaagaggtggaagcaggcaaagttgccgttcgcacccgccgcggtaaagacctgggcagtctggacgtaaatgacgtgattgagaagctgcaacaagagattcgcagccgcagtcttcaacaactggaggaataaagtattaaaggcggaaaacgagttcaaacggcgcgtccgaatcgtattaatagcgaaattcgcgcgcaagaagttcgcttaacaggtctggaaggcgagcagcttggtattgtgagtctgagagaagctctggaaaaagctgaagaagccggagtagacttagtcgaaatcagccctaacgccgagccgccggtttgtcgtataatggattacggcaaattcctctatgaaaagagtaagtcttctaaggaacagaagaaaaagcaaaaagttatccaggtgaaggaaattaaattccgtcctgggacagatgaaggcgactatcaggtaaaactccgcagcctgattcgctttctcgaagagggcgataaggccaagatcacgctgcgtttccgcggtcgtgaaatggcccaccagcaaatcggtatggaagtgcttaatcgcgtgaaaaacgatttgcaagaactggcagtggtcgaatccttcccaacgaagatcgaaggccgtcagatgatcatggtgcttgctcctaagaagaaacagtaaggccttcaagtaacaattctgtgaagccttcgggcttcacaggttttgttcgcctatgtttcgtttattaacaatgcgaagtggaagttattaaaatgccaaaaattaagaccgtacgcggtgctgctaagcgcttcaaaaaaaccggtaaaggtggttttaagcacaagcacgctaacctgcgtcacattctgaccaaaaaagcgactaaacgtaaacgtcacctgcgtccgaaagccatggtttctaaaggcgatctgggcttggttatcgcgtgcctgccgtacgcataagccgttaacgtttttaactttttaattagaatagatacaggagagcacatatggctcgcgtaaaacgtggtgtaattgcacgcgcacgtcacaagaaaattttgaaacaagccaaaggctactacggtgcgcgttctcgcgtataccgcgttgccttccaggcagttatcaaagctggtcagtatgcttaccgtgaccgtcgtcaacgtaagcgtcagttccgtcaactgtggattgcgcgtatcaacgcagcagcacgtcagaacggtatttcttacagcaaattcatcaacggcctgaaaaaagcctctgttgaaatcgaccgtaagatcctggctgatatcgccgtattcgacaaagtcgcgttcaccgcgctggttgaaaaagcgaaagcagctctggcataagccagtgaaaagagggagcctggctccctctcttttatttactgttcagtgagttgacaattgacctgtaacccttttcaataaaggatattcggttttaccacataaggtaacgcaagcatgaacgctgctattttccgtttctttttttactttagcacctgatcccaggaggctagcgcgtgaaaaacgaaacgaaaaacagcgtaaaaaagcctcctgatggaggctttttttgtatctgaaatcgagagattacgtccaatgaaccggtgtcttcaccgacacaatgaggaaaaccatgtcacatctcgcagagctggttgccaatgcagcggccgccattaaccaggcgtcagatgttgccgcgttagacaatgtacgcgtcgaatatttgggcaagaaagggcatttaacccttcagatgacgaccctacgcgatctgccgccggaagagcgtccggcagccggggcagtcattaacgccgcgaaagagcaggtacaacaggcgcttaacgcgcgtaaagccgagctggaaagcgcagcgcttaacgctcgtctggccgctgaaactatcgatatctccctgccgggacgccgtattgagaacggcggtctgcatccggtcacgcgtaccattgaccgtattgaaagtttcttcggcgagcttggttttaccgtggcgactggcccggaaatcgaagatgactaccataacttcgatgcgttaaacattccgggtcatcacccggcccgcgccgatcatgataccttctggtttgacgcgacccgtctgctgcggacccagacgtctggtgtccagatccggacgatgaaagcgcagcaaccgccgatccgtattattgcgccgggccgtgtataccgtaatgactacgaccagacgcatactccgatgttccatcagatggaaggtctgattgttgataccaacatcagcttcaccaacctcaaaggtacgctgcacgacttcctgcgtaatttctttgaggaggatctgcagattcgcttccgtccttcttattttccgttcaccgaaccttctgcggaagtggatgtgatgggtaaaaacggcaaatggctggaagtgctgggctgcgggatggtgcatccgaatgtgctgcgtaatgtcggtatcgatccggaaatctattctggcttcgcttttggtatggggatggaacgtctgaccatgttgcgttacggcgtcaccgacctgcgttcattcttcgaaaacgatctgcgtttccttaaacagtttaaataaaggcaggataaaacaatgaaattcagcgaactgtggttacgcgagtgggttaacccggcaattgatagcgatgcgttggctaaccagattacgatggctggcctggaagtagacggcgttgagccggtcgcgggaagcttcaatggcgttgtggttggggaagtggttgagtgcgcccagcatccgaacgctgacaaattgcgtgtaacgaaagtcaacgtcggcggagaacgcctgttggatatcgtctgcggcgcgccaaactgtcgtcaggggctgaaagtagcggtggccactattggcgctattctgccgggcgatttcaaaattaaagcggcgaaactgcgcggcgaaccgtctgaagggatgctgtgctccttctccgaactggggatttccgacgatcacagcggcattatcgaactgccggcggatgcgccgttgggtaccgacatccgtgaatacctgaagcttgacgacaataccatcgaaattagcgtcacgccgaaccgtgcggattgcttaggtatcatcggcgttgcgcgtgatgtggcggtactgaacaaagcgccgctccaggagcctgaaatggcgccggttacggcaaccatcagcgatacgctgctgattacggtagaggctgttgatgcgtgtcctcgctatcttggccgggtggtaaaaggtatcaatgttaacgcgccgacgccgctgtggatgaaagagaaactgcgtcgctgcggtattcgctccatcgatgcggtggttgacgtcacgaactatgtgctgctcgaactgggtcagccaatgcatgctttcgataaagatcgcattgatggcggtattgtcgtgcggatggcaaaagagggtgaaaccgtcgtcctgctggacggtagcgaagcgacgttaaatgcggacacgctggtgatcgccgatcaccataaggcgctggggatagccggtatttttggcggcgaacattccggcgtgaacggcgaaacgcaaaatgtgctgctggagtgtgcgtactttaatccgctgtctatcaccggtcgcgctcgccgccacggtctgcataccgatgcgtctcaccgctacgagcgcggggtggacccggcgctgcaatataaaacgatagagcgcgctactcgtctgcttcttgatatctgtggcggtgatgcgggtccgataattgatgtgagcaacgaagcaacgttgccgaaacgcgccaccattactctgcgtcgcagtaaactggatcgcctgatcgggcatcatattgcggatgagcaggtcagtgatattctgcgtcgtctgggctgtgaagtgaccgaagggcaggacgagtggaaagccgtggcgccgacctggcgtttcgatatggagattgaagaagatctggtggaagaggtggcccgcgtttacggctataacaatattccggacgagccaatccaggccggtttaatcatgggaacgcaccgtgaagccgatctgtcgttgaagcgggttaaaaccatgctgaacgacaaaggctatcaggaagtgattacctatagctttgtcgatcctaaagtacaacagctcatccatccaggcgcagaagcgctgctgctgccaaaccctatctccgttgagatgtcggcgatgcgtctgtctctgtggagcggattgttggcgacggtggtctataaccaaaaccgtcagcagaatcgcgtgcgtatttttgaaaccggtttacgtttcgttccggatacacaagccaatctgggtattcgacaggatctgatgctggctggcgtgatttgcggtaaccgctatgatgagcactggaacctggcaaaagagaccgttgatttctatgatttgaaaggcgatctggaagcagtattggatttaaccggcaaactgggtgatatccagtttaaggcggagatgaatccggctctgcatccgggacagtctgcggcgatttatctgaaagatgaacgtattggttttattggggttgttcaccctgaactggaacgtaaactggatctgaatggtcgtacgctggtgtttgaactggaatggaataagctcgcagaccgtatcgtgccgcaggcgcgggagatttcacgcttcccggccaaccgtcgcgatattgcggttgttgttgcagaaaacgttcccgcagcggatattttatccgaatgtaagaaagttggcgtaaatcaggtagttggcgtaaacttatttgacgtgtaccgcggtaagggtgttgcggagggttataaaagcctcgctatcagcctgatccttcaggataccaaccgtacactcgaagaagaggagattgccgctaccgtcgccaaatgtgtagaggcattaaaagagcgattccaggcatcattgagggattgaacctatggcgcttacaaaagctgaaatgtcagaatatctgtttgataagcttgggcttagcaagcgggatgccaaagaactggttgaactgtttttcgaagagatccgtcgtgctctggaaaacggtgagcaggtgaaactctctggttttggtaacttcgatctgcgtgataaaaatcaacgtccggggcgtaacccgaaaacgggtgaagatattcctattacagcacggcgcgtggtgaccttcagacccgggcagaagttaaagagccgggtcgaaaacgcttcgcccaaagaagagtaatcagatccaggcataacatccatcagggtgtattgcggcagatacgctgccatcccgaaagtagatcagcgggatgacagcgtatttgtcagcctgaaagatgacccgtataactaaaaaggccgcattgcggccttttttctttcaagtaaaggatacccaccgtaaaatcacgctacctcttttcagctgaatggataacatgctgacttttgcccgccaacaacagcgacgaaacgttcgctggcttctgagcctgtcactgctggtgctactggctacacttctgagcttatgcgcaggcgaacagtggattgcccccggtgactggttaagcgcccggggggaactgtttgtctggcaaattcgccttccccgcacgcttgcggtattgctggttggcgctgcgctggcgctatctggcgccgtgatgcaggcgctgtttgaaaacccacttgctgaaccgggtctgctcggcgtttcgaatggggccggtgttgggcttattgccgccgtcttactggggcaggggcaactgccaggatgggcgctggggctgtgcgctatagccggcgcgctcattattacgttaatcctgctgcgttttgcgcgtcgccatctctctaccagccgcttgttgttggcgggcgtcgcgctgggcattatctgtagcgcgctgatgacgtgggctatctatttttccacctctttcgatctgcggcaattaatgtactggatgatgggaggatttggcggcgttgactggcagcagagctggctaatgattgcgctcatcccggtactgatctggatatgttgccagtcgcaaccgctgaatatgctggcgctaggggaaacctcggcgcggcagcttggcctgccgctgtggctctggcgcaatttgttggtcatcgccaccggctggatggtgggcgtcagcgtagcgatggcgggggcgattggttttatcggtctggttattccgcacatcctgcgcttatgtggtttaaccgatcaccgggttttacttcccggctgcgcgctggccggggctatcgccctgctattggctgatgtggtcgcccgactggcgctggcgtcggctgaactgcctatcggggtggtcaccgccacattgggggcaccagtgtttatctggctgctactcaaatccgcgcgttagcgcatcggtaaacaactgctttcatcattcgcagtctatgattaaaggctaacgatgaaacccgctattctaccgacatcagggagacaccatgcaaaactcgcttcttaatactcacgttacgacgattgatggagaggtcactacacttgaaaaatacgccggaaaagtgctgctcattgtaaacgtcgcctccagatgtggcctgacgccgcaatatgaacagttggaaaatatccagaaggcgtgggcagatcaggggtttgtcgtgttgggttttccctgcaaccagtttatggggcaggagccaggcagcgaagaggagattaaaacctattgtgccagcacctggggcgtcacgttcccgatgttcagtaaaattgatgtgaatggcgacgcgcgccatccgctgtatcaaaaactgatagccgctgcgccaacggcagtcgcgccggagaagagcggcttttacgaacggatggtaagcaaagggcgtacgccactctatccggatgatattctgtggaattttgaaaaatttttggtaggccgggatggtcaggtggtacagcgtttttcgccggatatgacgcctgaagatcctattgtgatggaaagcataaaaatcgcgttggcaaaataatgtctcaattgatgcaattaaaggacgtcgccgagagcacccgcctggggccgctttccggcgaagtaagcgcaggagagatccttcatcttgtcgggccgaacggcgccgggaaaagcacgctactggcgcgtatggcggggttaacctccggcgaggggagcatcaggtttggcggagcgccgctggaggcatgggcgacggcaacgcttgcccaacaccgcgcttatcttgcgcaacagcaaaatccgccgttcgccatgccggtctggcattacctgacattgcatcaacctgataaaacgcgaaccgggcagcttaacgaggtggccgatatgcttggattgggcgacaaactggggcgaagcgtgaatcagctttccggtggcgagtggcagcgcgttcgccttgctgccgttgtactacaaattcatcccgacgctaatccggtcggtcaattattgctgcttgatgagccgatgaacagtctcgatgttgcgcaacaaaacgctctggatcgggtattacatcatttatgtcaggcaggaattgcgattgtgatgagtagccacgatctgaaccacacgctgcgccatgcgcataaagcctggttactaaagcgcggtaaactcattgcctgcggccgccgggaagaggtgctcaccccctcttatctggcgcaagcctacggtttgcgctttcgacgactcgacgtcgaggggcatccaatgctcatttcggccacttaagtaaaatcgtttcttgaaaagcaggtaatttcgacgctaaattaataccaaaataaaaacagaggattgttgcggcatgcgtttttggcttcttgttatcacagcattgttcctggcaggatgcagtactcatcgggcaccggcgccaaatgccagattatcagactccattaccgtcattgcgggtctgaacgatcagttgcagtcctggcgcggtacgccataccgctacggcagcatgagtcgcagaggcgtggactgttccggctttgtggtagtcactatgcgcgacaagtttgatttgcagttgcctcgtgatacgcgtgaacaatcaaaaatcggcaccagaatcgataaagatgaattgctgcccggagatttggttttctttaaaaccggttcgggcgaaagtggtttacatgttggtatttacgatacaaataatgagtttattcatgcctctaccagtcgtggcgtgatgcgttcatcgctggataatgtgtactggcgaaaaaacttctggcaggcacggcgaatttaacctcgcagacgatataaattttatagtctatttttaacatatcgccagttgaacttatgacatctgttgtcatcatatataatgatataaccgtagcatttacaaacgtacttttattaaaaacgggcgtgctcacgccctgttaaaagtacaacattggatattggtttataatcagagtaagttaaaaaaaggaaccggttcaccggtaaacaagaaaaatgatgacgcttcaattagtatctgaagttacgtctgtttccgtccgtagtgactggatggtgaatagcgccctaaccatgggactggcgtaatgattgcttcacttgatgagctttaccattccgaactctttttccttcccgtcatggatgaaaacgctcggcttgttggtttagagattattgcaacgtttgccgctgaagacggcgccgtgcggatgccgactgagttggtagcgcctcgcctttcggtggaggaacaatactgtctgtttgttgaaaaactggcgttgttagaaacctgtcagcacttttttattcagcataaacttattgcatggcttaatttaccgcctgcaattagtgacttattattattagatagcgaacttttttcccgggcagcgcgctttccgttttttgaagtagctataaatgagaattatcctgggttaaaccagggcaaaaacaatgaaacgttagctaatctggcaatgcatttcccattaattttggcaaattttggggcaggcgaggcgtcgactaaagctattttcgatgggcttttcaaacgagtcatgttggataaaaattttattcagcagcgagctgaaatgatctcattcgaaccattcatgcacgctattgttgcccagatctcctccagctgcgagtcgctgatgattgccggtattgatactgaggcgatgtttgcgcgcgcagcgccattggggtttagcgcattccagggcggactatggcctccggtgccggtaagccagctcattaaactcgttcagcgataacctttctgtttgccggtgtttaaccggtgattaaccgtctacactgaagacaggaggccctatgaccctgtcttttactgcccgttggcgcgatgaattgccagcaacgtataccgcgcttttacccacaccgttaaaaaatgcgcgactgatttggtataacgacgaactggcgcagcagttagccattcccgcttcgttatttgacgctaccaatggcgctggcgtttggggcggcgaaaccttattacccggtatgtcgcctgtcgcgcaggtatatagcgggcatcagttcggcatctgggcgggacaactcggcgacggacgcggtattttgctgggcgaacagctcctggcggatggctcgaccctcgactggcatctgaaaggcgccggattaacaccctattcgcgaatgggagatggacgcgccgtcctgcgttcaaccatacgagaaagtcttgccagcgaagctatgcattatctgggtattcccactacgcgcgcgttatctatcgtagccagcgatacgccggttcagcgagagacgcaggaaacgggcgcgatgttaatgcgtctggcacaaagtcatatgcgttttggtcatttcgaacatttctattaccgccgtgagccggaaaaagttcagcaactggctgatttcgctattcgccattactggccgcaatggcaggatgtagcggaaaaatatgctttgtggtttgaagaggtggcggcgcgtaccggaagactcatcgccgagtggcaaaccgtcggtttttcgcacggcgttatgaatacggataacatgtcgattctggggctgaccatcgactatggcccctttggttttctcgacgactacgatcccggcttcattggtaaccattccgatcatcagggacgttaccgcttcgataatcaaccgtcggtggcgctgtggaatttacaacgtctggcgcagacgttaaccccttttattgagatcgacgcgttaaacagagcgctggatcgttaccaggacgcgttgttaacgcactatgggcagcgaatgcgccagaagctgggcttctttaccgagcaaaaagacgataacgctttactgaatgaattgtttagtctgatggcgcgcgaagggagtgattatacccgtacatttcggatgttaagccatacggagcaacagagcgcctcctcgccgttgcgggatacgtttatcgatcgcgcggcgttcgatgcctggttcgaccgctaccgggcgcgattgcgcacagaggcggtggatgacgcgctgcgccaacagcagatgcaacgcgtgaatcctgcgattgtgttgcgcaactggctggcgcaacgcgcgatagatgcggctgaacaaggagacatggcggaactgcatcggttgcatgaagttttacgtcaaccttttaccgatcgagatgatgactatgccagccgaccgccggagtggggaaagcggctggaggtcagttgttcaagttagccagatgccagcagaatcgtctgctggcgggagcgctatttggttaacagtagcttaccggcctgagttttgcgcaacagatactcctgaccgttgtgatcgataatgactttgccgtccggacctaatagcgcctgactgttgacgcgccgttcagcggcagggagaagcgtttcattgtctatttccttagggtgaggcagctcggtgttatccatacgcgacatgttatttattaataatcaaactcacaatgattattattatcaataattaatgcgataacagcaagtgctaattctgtggagtgatatacgcgcgcgtagagaaaagggtgggtaacgcatcgaagaaacgcccatcccggcaggatgggcgagctattaaaagcggctgtctaccgccgcggcaagtttttccaacagaacttccgtatcttcccagttcaggcagggatcggtaatggattgaccatagattaacggttgaccgctgataattttttgcgtgccttcccgtaaaaaactctctgccataatcccggcaattgccgtggagccattacgaatctgctggcaaatatcatcacatacgtccaactggcggcgatgctgtttttgacagttgccgtggctgaagtcgacgaccagatgttccggcagatcaaattcatgcaacgtgtcgcaggcggcggcaatatcttcagcgtggtagttcggttttttaccgccgcgcatgatgatgtgcccatacgggttgccactcgtttggtagatagtcatctgtccgtctttatccggcgagagaaacatatgactggcgcgggaggcgcgaatagcatcaacggcaatgcgggtattgccatccgtaccatttttaaagccgaccgggcaagagagcgcagaagccatttcccgatggatttggctttcggtggtacgcgcgccaatcgttccccaactgatcagatcggcaataaactggccggtgaccatatcaagaaattctgtggcggtcggtactcccagttcgttcacctgcaatagcaagcgacgcgccagttcaagcccatgattgacgcggtaactgccattcaagtcgggatcggaaatcaggcctttccatcccacgacggtgcgcggtttttcaaaataggtgcgcatgacgatttccagacgcgcctgatgcttttggcgttgtgcctggagctgcgtcgcgtattccatggcagcattcagatcgtgaatcgaacaggggccaatgacgaccagtagccgtggatcttcaccatttaaaatcttttctatccggcgtcgggagtcggtaacgtgactggcgacggaggacgatacaggataccgctgcgcgagttcggttggtgttaccaggctgtcgatacgcgcagtacggagttcgtcggttctgttcattacaagtctcagaaatttgttgtttcaacggcaggactaccgggaagtgatgggcatcacgataaaccaatccctgctgatttcaagtgcgaggcgtgtcacacctcgcaggcagaacggcatgataacaaaaaccaatccattaaactagtttactagtacatcctgcggttaagccccataatatcgagaatcttggtggctatctcttcaacggaataattggtgctgttcaggcaggggatctgattcttacgatacagcgcttcgacctccgccacttccatgcggcactgacgcaacgaggcatagcgactgttttcacggcgttcttcgcgaattgccgccaggcgttcagggtcaattgtcaggccgaacagtttatgttgtagcggttttaacgatgtgggcagcgtcaaattatccatatcatcggcgatgaaagggtagttagccgcacgaataccgaattgcattgccagatagagactggtgggcgtttttccacagcgcgaaacgccaagtaaaatgacctgggcctgatcgaggttgcgcaatgaaatgccatcatcatgcgccagggtataatcgatagcggcaatacgggcgtcatacttgttcaggttacccggattaagcccatgagtacgatgagcgatcggcgtcggatccagtttcatctcctgctgaagcggcgccaccagcgcctggacgatatcctggcagaagccttcgctctgcaagatgatggcgcgaatttcaggtaaaacaatcgagtaaaacaccagcgggcgaacgccggtttgctgataaatggcgtcaatttggtctttgacggcgcgggcgcgactttcgttttccacgaatggcagcgtgatgctgctgatcgtcaccggaaactgcgacataaccgcgtgacccaggacctcggcggtgatggcggtaccatcagaaatatagaaaacatggcgatcaacaacattatccattctgttcatcctgaagagtaaacataattatctgaaagcataaattaaaagtaacgggaaacgtataacttgtcgcttattttataaaatgacaggcactttttataattaatgaaaagtgtgtttcatttccttgaaacgcagtttatgccgggagtgattaagggaatgccgtgctatgcgcgggtttgcgcaactacgtaaacaatctgaaaaaatgaaaaaataaatttgcttgaacgattcaccgtttttttcgcgggtttaagtatgccaggataaatacgcaactatgtgtttcttaaactcgttcatttatcacaaaaggattgttcgatgtccaacaatggctcgtcaccgctggtgctttggtataaccaactcggcatgaatgatgtagacagagttgggggcaaaaatgcctccctgggtgaaatgattactaacctttccggcatgggcgtatccgttccgaatggttttgcaaccactgccgatgcgtttaaccagtttttggatcaaagcggcgtaaaccagcgcatttatgagctgctggataagacagatattgatgatgtctcccagctggcgaaagcgggcgcgcagatccgccagtggattatcgacactcctttccagccggcgctggaaaacgccatccgcgatgcctatgcgcagctttcgtcggatgatgaaaatgcctcttttgccgtgcgttcctccgccacggcggaagacatgccagatgcttcgtttgcgggtcaacaggaaacgtttcttaacgttcagggcttcgatgcggtactggtggcagtgaaacacgtatttgcttctctgtttaacgatcgcgccatctcttatcgcgttcaccagggatatgatcatcgcggcgtagcgctttccgctggcgtgcagcggatggttcgctccgatctcgcctcgtcaggggtgatgttctctatcgataccgaatccggctttgaccaggtggtctttatcacctcggcatggggactgggtgaaatggtggtgcagggcgcggttaacccggatgaattttatgtccataagccaaccctggcggcaggccgtccggccatcgtacgccgcaccatggggtcgaaaaaaatccgcatggtttacgccgccacccaggagcacggtaagcaagtgaagattgaggatgtgccgcaggaacagcgcgacattttctcgctcaccaacgaagaagtgcaggaactggcgaaacaagcggtgcagattgagcagcactatggtcgtccgatggatatcgaatgggcgaaagacggtcataccggtaagctctttattgtgcaggcacgtccggaaaccgtgcgctctcgtggccaggtgatggagcgttatacgttacatgcgcaggggaaaatcattgccgaaggtcgtgccattgggcatcgtatcggcgcaggtacggtaaaagttattcacgatatcggcgaaatgaaccgtattgagcctggcgatgtgcttgtcaccgatatgaccgacccggactgggaaccgatcatgaaaaaagcggcggcgattgtcactaaccgtggcgggcgcacctgtcacgcggcgattatcgcccgcgaattgggcattccggcggtagtcggctgcggcgacgccaccgaacgcatgaaagatggcgaaaaagtaaccgtctcctgtgcggaaggtgataccggttatgtgtatgccgacatgctggatttcagcgtaaaaagctccagcgtagataccatgccagagctaccgctgaaggtcatgatgaacgtcggcaacccggacagggcatttgactttgcctgcctgccgaatgaaggcgtaggtctggcgcgactggaattcatcattaaccgtatgattggcgttcacccgcgcgcgttgctggagtttgacgaccaggatgccgcgctgcaaaacgacattcgtgagatgatgaaagggtttgactcgccgcgtgaattttacgttggtcgactgacggaagggatcgcgacgttaggcgccgccttctacccgaaacgcattatcgttcgcctgtctgactttaagtccaacgaatacgccaacctggtcggcggcgaacgttatgagccgcatgaagaaaacccgatgctgggcttccgcggcgcgggtcgttacgtcgcagaaagtttccgcgattgttttgcgctggaatgcgaagcggtgaaacgcgtgcgcaacgatatgggccttaccaacgtcgaaatcatgatcccgttcgtgcggacggtcgaccaggcgaaagcggtcatcgaagagctggcgcgccagggacttaaacgcggcgagaacgggctgaagatcatcatgatgtgcgagattccgtccaatgccttgctggctgaacagttcctcgagtattttgatggcttctcgattggttctaacgacatgacgcagctggcgctggggctggatcgcgattccggcgtggtgtctgaactgtttgacgagcgtaacgacgcggtgaaagcgctgctatcgatggcgatccgcgcggcgaaaaaacagggcaaatatgttggaatttgcggccagggcccgtccgaccatgaagactttgccgcctggctgatggaagaggggatcgacagcctgtcgctgaacccggacaccgtggtgcagacctggctgagtctggcggaactgaagaagtaaaccgcgaccagataacgctatgcttatccggcctgcacaagaaacatgttgtgtcggccggatagggcgtaagttgcccgacgcctgcataatgccggatcaggcgttgtgcagaatcattaatacactgcgtagatcatttacggcgatttgccccggcgctgaagcctgcttcaccgcgccaaacgtggcggcagagccaaacacttcccctgccagacgtgaaatgacaccctctttcgccattgacatagtaattaccggacggtcggcgtaatgttgctgcatctccagcgtggcagtgagtaacgttaatacatcatgcttgctttgcggcataacggcaatcttgggaatatccgcgccgagtgcttgcattttacgtagccgcagaaccatttcctctgcggacggcgtctggtgaaaatcgtggttagacatcacgacataaacattatgcgcatgggcataatcgacagtggctttaacgtcagcatcaccggtaaatagctcaagatcgatcatatcgaccaggccgctgtcgattgcggcacgattaagcgtgagataatgctgagtggttattgtctgctcgccgccttctttggcgctgcggaaagtaaacagtaacggaatgtcaggcatcgcatcgcggataacacgcgcagcggtaagaacggattgagtcgatgcgatatccataaagtgatccacgcgccactccagaatatcgaatgtagcttcgcggtaggccagcgcctccgctttcacgctattgatgtctcttcccatcaacgacacgataattttgggcatcccttcgccaatgataagattttttacggtgacggttttcatgcgtgtcctgtcagttttttttcttctcgccattatgaacggtgaggctggccgcttgaagtaaaaaaaaaagcccatcgtaggagacgggcaaagactacacacagcaattcgttgtttcactcaggggatttccatgcttataaatcaatgtgttgatttataaccgtgtgctaatagtaggcatgagcactttttgcgtcgatcagattcgtctcaatagtttaaaaactgtaacggatttgcgacagaaatgagatgcggcggggaacagacgggcgaatcaaaatggggtgtgcgttgaattgataaacgtcgctaaagcatcgggcggcaatgccgcccgacgggattatgactgcttgttggcttcctcgatgtcatccagctcttcaaggatctcctctggttcattcgtcggcgccggaacttcatgtacccatgcggagaacaaacgccaggtcacggccagaagcaccggtccaataaacagaccaatcataccgaatgcaatcaggccgccgattaccccggaaaggatcagaagcagcggtaaatcggcgcccatgcggatgagtaccgggcgaatcacgttatccagagtgccgacgacggcgctccaaaccagcagcacggtgccccaggtggtgtcgcctgtccagtaaagccagataatggctggaatcaataccggcaacggccccaactgaaccaggcacgaaaggatcatcactaccgtcaacagggtagcgtaaggcacgccggaaatcgccagcccgacgccgccaagtaccgcctgtaccagcgcggtgaccaccacgccaagcgccacggcgcggatcgcctgggcagccagcagaaccgccgcatcgccgcgtttagccgcgagacgacaggcaaaatggcgtatacccatcgccacttgttcgccgcgccagtaaagcagggcgctaaacaacagcatcagggcgcagtgcatcataaagcgtccgatatgcgccgcctgaccgacaaaccagatcgtggttgtgccgatataaggccgcactttcgccataatagcgctaccgcccatatccagcaggctatgccatccggcatacagtttggcgccaactaacggaatattatttaaccatgccagatcgggtagcgtcatatcgccgccggtcactgcatggatgagcgggccgctaccatcgacaatgctgttcaccagcaaggcgacgggaataacgaagagcagcactaacagcagcgtcatgaccagtacggcaagcgagcggcggccccacaatattttttgtaatttcagcaaaacgggccaggtcgcgataacaatcgtacctgcccatgcaaaccccaaaataaaaggctgtactatccacaaacaggccacaatcatgatggctaaaaacagcaccgatagcagcacttgcgcaatatccctgggctgacgaacatttaccataaatacttttcacctttgtctttgcgccagaacgttggcgcgacgtgaacatgcaaaccacaccctataatgatgagcaatttcagcggtttttaacaggccgattctgcatgtaattctgttgggcgcacaggaaaaaaatgtgatacaacaaataacgcaacacgcaaacgattaagcatcccttcctgtgcgtagaccgctcgcgctcgccgggttgggcgccaccgttcacaacatagaccgcaggaaaaggtcaatataatgattccacaaatttctcaggcacccggcgtcgttcagctggtgctcaattttttgcaggcgctggagcagcaagggtttacgggcgatacggcaaccagctatgccgaccgtctgacaatgtcgaccgataacagtatctaccagcttcttcccgatgctgttgtgtttccccgttctacggcggatgtcgcgcttcttgcccgtctggcggcggagccgcgctttacgtcgctgatatttaccccgcgaggcggcggtactggcacgaatggccaggcgctaaaccagggcattattgttgatatgtcccgctatatgaaccgcattattgaaattaatcctgaagagggatgtgtgcgggtagaggcgggagtgataaaagatcagcttaatcaagcgttaaagccgtatggctatttttttgcgccggaactttccaccagtaatcgcgccacgcttggcggtatgattaataccgatgcctctggtcagggttcgctggtctatggaaaaacgtcagatcacgtcttaggcatacgggccgtattgttggggggcgatatccttgacacgcaatcgatgcccgtagatcttgcccggacgctgggtgaaaacacgacgacgccaggccgcatctatcagaccgtctatcagtcctgcctggaaaaccgtcaacttatcctcgatagctttccaaagctcaatcgcttcctgacaggctacgatttacgccacgtctttaacgatgacatgacccgcttcgatctcacccgcatcttaacggggtcggaagggacgctggcgtttattactgaagcccggctggatattaccccgatacccaaagtccgccgtctggtgaatgtaaaatacgactcctttgattccgcgctgcgtaacgccccttttatggttgacgcgcgcgccttatccgtcgagacggtcgattccaaagtccttaaccttgcgcgggaagatattgtctggcactccgttagcgaattgattaccgatgtgccggataaagagatgcttggcctgaatatcgtggaattcgcgggtgatgatgaagcgcttattgacggacaggtcgaggcgctgtgccaccgactggatggcctgatggcgcgtgcggaagcgggcgtgatcggctggcaactttgtaccgatttgacgggtattgagcgtatttacgcgatgcgtaaaaaagcggtagggctgctgggtaatgcgaaaggcgctgccaaaccgattccttttgcggaagatacctgtgtgccgcctgaacatctggccgattacatcgccgaatttcgcgctctgctggatggtcatggcttaagttacggcatgttcggccacgtggatgccggggtgctgcatgtgcgcccggcgctggatatgtgcgatccgcagcaggaactgttgatgaaacagatctccgatgaggtcgtcgcgctgaccgccagatacggcgggttgttgtggggcgaacatggaaaaggtttccgtgcggaatacagcccggcctttttcggcgaagtcctgtatggcgagctgcgcaaaataaaagcggcttttgatccgcataatcgacttaacccgggtaaaatctgtccgccgcaggggatagaggcgccgatgatgaaggtggatgcggtaaaacgcggcacctgggatcggcaaatcccgctggcggtgcggcagacctggcgcggcgctatggagtgtaatggtaacggcctgtgctttaatttcgatgcgaaaagcccgatgtgcccgtcgatgaaaattagccttaaccggatccactcgccgaaagggcgggcgacgctggtgcgggaatggctccgtctattggccgatcgcggcgtcgatccgttgaagctggaaaaggagctgccggaaaaacgcgccagcttgcgcacgctgattgcccgcacccggaatagttggcacaaacgcaaaggcgagtatgacttttcccatgaagttaaagaggccatgtccggctgtctggcatgtaaagcctgtacgacccagtgtccgattaaaatcgatgttccggagtttcgttcacgtttcttacagctttaccatacgcgttatctgcgcccggtacgcgatcatctggtggcgacggtcgagacctacgcgccgctgatggcgcgtgcgccaaagacctttaacttttttattaaccaaccggtggttcgtaatctggcgaaaaaacatatcggtatggtggatttacctctgctttctgccccttcattgcaacagcaactggtgggccatccgtctgccaatatgacgcttgagcaactggagcgcatgagcgccgagcaaaaagcgaaaacggtactggtagttcaggatccgtttaccagctactacgacgctcgggtcgtagcggactttatccgcctggcggaaaaactgggcaggaggccggtattgttaccgttctcgccgaatggtaaggcgcagcatattaaaggttttcttaatcgctttgcgaaaacggcgaaaaaaacctctgagttccttaatcggatcgccgcgttggggatgccaatagtgggcgtcgatccggcgctggtcctgtgttatcgcgacgaatataaactggcgctgggcgaacagcgcggcgattttcatgtgttgctggtgaatgaatggctggcgcaggaaataaatgcaagactgtccgtcgaggtaagcggtgaaccgtggtacttttttggtcattgtacggaagtcacggctttacccggcgcgcctgcgcagtgggccgccatctttgcccattttggcgcgaagctggaaaatgtcagcgtaggctgctgcggtatggcgggcacttatggacatgaactcaccaatcataaaaattcgctgggaatttatgagctatcctggcatcaggcgatgcaacgtctaccgcgaaaccgctgcctggcaaccggctattcctgccgaagccaggttaaacgcattgaaggtacgggcgtgcgtcacccgttgcaggcattactggagattataggttgatctggaaacgtgaagtgaccctcgatgcgcttaatgcgatgggggaagggaatatggttggcctgcttgatatccgctttgagcgtattggggacgatacgctggaagcgacaatgcccgtcgatcatcgcaccaaacagccgttcggcttgctgcatggcggagcgtctgtggtgctggcggaaagtatcggctcggtcgcaggctatctgtgtacgcagggggagcaaaaggtggtggggctggaggtgaatgccaaccatgtacggtcggcgcgtcaggggcgcgtacgaggcgtctgtaaagcgttgcataccggggctcgccatcaggtctggcagatagagatctttgatgaacagggacgtctgtgctgttcttcgcgccttactacggcgattgtgtgacgttgtcaccataaaagtgtgatgcatattgcttttggtcaaaatgtgcgcagaaaaaggtgatatactgtgcacgtttacacataagcgaggatgatatgtctattgatttagacccaacccaactggcgattgaatttttacgccgtgataaaaccgaactttctcccgcgcagtatttgaagcgtttaaaacagctggagttagagtttgccgatctcctcaccctctctgcaaccgaactgaaagaagagatctatttcgcctggcggttgggcgtgcattaatagagtctgtgtaggccggataaggcgttagccgccatccggctatgttaccaggcaatctcaccagacactgtcccccggtaatagataacccccttgattttgtgtaaaaaaaatacagatcgccatttgtgctaaaaaggtgcgctctctttatgagattattcttatgccccttcaagagctaagccattaagagtgccggagataagcgccggatggggccggaacccttaagcctgtattgaacagacttaagggtttttcttttccgggcgcgtaaaaaactaaggtctgtcaataaccgctggcatgtcgtcagccctattattattcaaaatacggttagccagcacacctgacatcatcgatccgttaacgttcagagccgtgcgggccatatcaacgataggttcgatggcaataaaaataccgaccagcgcaacgggaaaattcaacgtcgacaggacaatcagcgccgcgaacgtaccaccgccgccgacgccggctacgccaatagaccctagcgcaatggcaggcaacatcgcggccagaaaatgcagcgagagcggatcgatgccgatggtgggcgcaatcatcgctaccataatagccggataaatcccggcgcagccattttgccccatactggagccaaacgaggcggaaatattggcaatggtgctttgtacgccaaatttttcctgggcggaaatggccagcggaatagaggctgcgctgctgcgggagacaaacgcaaaggttaagacgggccagaccattctgaaataatgcgctggattattaccgctgaggatcagcaagatggcgtgcacgataaacatcatgaaaatcgcgatataacaggcgccgataaaaccaagtaagctggcgaattgttcaaggcggtatgatgaaaatacggtggtcattaatgccatgacgccatagggcgttaatgcaataacgatacgtaccatcttcatgacccagatctggatagcgttaatgcctgcgcttaatttctgaccttcttccggcgcctcttttttgacctttaacagggcgatccccgctattagcgtgaagataacgatgccgataacggaaacacttctggctcccgtaagatcaagaaaaatatttgtcgggatcagcgatgtcactaactggggaatcgacaccgcggcagtcttattgacttcttctgtagttaacattgacggcatgtgcacaaaagcgctggcgtcaagccccagtatatgagcggtcagtaatccgataaaaccggcaaccatcaccaggcataacatgcatccgacgatcgtcagcgacatttttccgatgccggcgctattttccagtttattgatggcggaaagaatagaaataaaaattagcggtatagcgaccagttttaacagatggacgtagccattgccgacgatgctgtaccattcgataatggttttagtgtgatttgctgaaataaaatgcagggataaaccaataacagcccctaaaaagatagcgataaaaacgcttttcgacagggaatcgcttttttgattaattctcaagatggcccacgagaaaaccaaaaaaagtgcgatatacgcgagcgtaacaaccatattttaagcctcttgcctcattcagcacctgaaatgccggaaagagtttacataaacctatagctcaaactgagttatagaaccgcagcggattataaagagcgcaacgccaggtatccatacaaaaaatggggttctgacctcgccgcccggcaatgtcgacagcctattaattaaatagtcattttctatacatcttttcgtttttgacctgccagaacggttaatgtcttataaatcattacttatcaaaaagttaagtggttttttgtctgtcgtatgacctggcggacagggtctatgcttaataaaaggcgctcaatatgaccatttgttggaaagcccctgcggttaaggggttgaagtgataatcattatcactaacatgctgttatatcctggtgatttagaacgcgaggtaactctatggaattgcattcaggcacgtttaacccggaggacttcccctggcaagggctgacgctaacgccagcggcggcagcgcacatacgtgaactggcagcaaagcagccgggcatgttgggcgtgcggttaagcgtaaaacagacgggatgtgccggatttggctatgttctggataccgttcgggagccggataaagacgatctggtttttgaagccgaaggcgcaaagcttttcgcaccgttacaggcgatgccttttattgacggaacagaagtggattacgtacaggaagggctgaaccagttatttaaatttcataaccccaaagcccagaatgaatgtggctgcggcgaaagttttggggtataggcggtactatgtctcgtaatactgaagcaacggaagaggtcggcatctggacaggcggacgccttaattacaaagaaggatttttcacgcaattacccactgatgaactggcaaaaggcatcagcgaagaggtggtgcgtgcgatttccgcaaagcgtaacgaacctgattggatgctggaatttcgcctcaatgcctatagagcctggctggacatggatgaaccgcactggctgaaagcgcattacgataaactgaactatcaggactacagctattactctgcgccatcatgcggaaactgcgacgatagctgcgtttcccagccgggagccgtacagcaaacgggcgcgaatacctttttgagtaaagaggttgaagacgctttcgagcaacttggcgttccggttcgcgaagggaaagaggtcgccgttgatgcgatttttgactcggtctccgtagcgaccacataccgtgaaaaactggcggaacagggcattattttctgttcttttggcgaagcgatacacgatcaccctgacctggtcaggaaatatcttggcaccgtcgtgccggggaacgataacttttttgccgcgctgaatgcggcagtcgcttccgatgggacatttatctatgttcccaaaggcgtgcgttgcccaatggagttatccacctattttcgcattaacgctgagaaaaccggtcagtttgagcgcacgattctggtggcggatgaaggcagctatgtgagttatatcgaaggctgctccgcgcccgtacgcgacagttatcagctccacgccgcggtagtggaagtcatcatccataaagatgctgaagtaaaatattccaccgtacaaaactggttcccgggcgacaacaacacgggcggcattctgaactttgtgaccaagcgggcgttgtgcgaaggggaaaacagcaagatgtcgtggacccagtcggaaaccggttcggcgattacctggaaatacccgagctgcattctgcgcggtgataattctatcggcgagttctattccgttgcgctgaccagtggacatcagcaggctgacaccggcaccaaaatgatccatatcggtaaaaacacgcgctcaaccattatctcaaaaggcatttccgccggccacagccagaacagctaccgtgggctggtaaaaattatgccgacggcaaccaacgcccgaaatttcacccaatgcgactccatgttgattggcgcggactgcggcgcgcatacgttcccgtatgttgaatgccgcaataacagcgcgcagctggagctcgaggcgacgacatcacgcatcggtgaagatcagcttttctattgtctgcaacgcggcatcagcgaagaagacgctatttcgatgatcgtcaacggtttctgcaaagacgttttctcggaactgccgctggagttcgccgttgaagcgcaaaaactgctggcgattagccttgagcacagcgtcggttaatgatgaaggaaaacccatgttaagcattaaagatttacaggtcagtgtggaagaaaaggcgattttgcgtggcctgaatctggatattcgccccggcgaagttcacgccattatggggccgaacggttccgggaaaagcacgctctccgccaccctggcgggacgtgaagattatgaggtcaccggcggctcggttacgttcaaaggtaaagatctgcttgaactgtcgccggaggaacgggcgggcgaagggatttttatggccttccagtacccggtagaaatccccggcgtcagtaaccagtttttcctgcaaaccgcgctgaatgccgtgcgcgcctatcgagggcaggcgtcgttggatcgctttgattttcaggatctgatggaagaaaagatcgcattgctgaaaatgccggaagatttgctgacccgttcggtaaacgtcggtttttccggcggggagaaaaagcgcaatgatattttgcaaatggcggtgctggaaccggaactgtgcattcttgatgagtcggactccggactggatatcgatgcgttgaaaattgtggcggaaggcgtcaacgcgttacgcgacgataaacgcgcttttattatcgtgacccactatcagcgcatactggactacatcaagcctgattacgtccatgtcctctatcaggggcgaattgtccgttccggcgattttactctggtcaaacaactggaggagcagggttatggctggcttaccgaacagcagtaaagcgctacagcaatggcagcatctctttgaagaaaaaggagaaattcgaactgagcaggcaagacaacatttccaacagatgttacgtctgggattgccgacgcgtaaacatgaagactggaaatacacgccgctggagggcttaacccatagccagtttatccagcagtgtgcgactatcagcgccgcccagcgtgatgcgctggcgctgcaaatcgatgccgtgcggctggtgtttgtcgacggacggtttatgccagagctcagtgatagcacgcaaaacagcggatttgacgttagcgtcagagatgagcgccagacgcttgccgcgccggtacatcccgaggtttttctgcatctgacggaaagcctggcgcaatgtgtcacgtatatacaggtacggcgaaatcagcgtccgaccaggccgctactgttaatgcatatcacgcagggcgtggatagcgacgagctgaataccgcgcattatcgccaccatctgacgctggcagaaggcgcggaagcgacggttattgagcattatgtcagccttacagcggcaaaacattttaccggcgcgcgtctgacgatgaacgttgcagacaatgcgcaactgcgtcatatcaaactggcgtttgaaaatgcgtccagctatcactttgcgcataacgatcttctgctggcgacagacgcctcggcgtttagccacagttttctgctgggcgccgcagtactacgtcaccacagcagctcacaactgaatggcgaaaacgcgacgcttcgactgaatagtctggcgatgccagtgaaaaatgaagtctgcgatacgcggacatggctggaacataacaaaggctactgtaacagccgccagttgcacaagaccatcgtcagcgacaaaggacgcgcggtctttaatggcctgattaacgtggcgcaacactccattaaaaccgacggccagatgaccaataataacctattgttggggaaactggctgaagtcgataccaaaccgcaattagagatctatgccgatgacgtgaagtgcagccacggcgcgacgatcgggcgtattgacgatgagcagatgttttatctgcaatcacgcggcatcaggcagcaggaggcgcggcacatgattctttacgcgtttgccgcagagttaacggaagctatccatgatagcgcccttaaacagcaggtgctggcgcgaatcggccagcgactgcccggaggcctggtatgacatttcctgtagaaaaagtacgggcggattttcccatactgcagcgtgaagttaacggcctgccgctggcttacctggacagcgcagccagcgctcaaaaacctaatcaggtgattgatgctgaatctgccttctaccgtcacggctatgctgcggtacatcggggtatccatacgttaagcgcgcaggcgaccgaaagcatggagaatgtgcgtaagcaggcgtcgcggtttattaacgcccgctccgcagaagaactggtgttcgtgcgcggtacgacggagggcattaaccttgtcgccaacagttggggaacggaaaatattcgcgccggggataacattatcatcagcgagatggagcatcacgccaacatcgttccctggcagatgctgtgcgagcgcaaaggcgctgaactgcgcgtgatcccattgcatcctgacggtacgctgcggctggagaccttagctgcgctgttcgatgaccggacccgactgctggccattacccatgtatctaatgtgctggggacggaaaacccactgccggacatgattgcgctggcgcgccagcatggggcgaaagtgctggtggatggcgcccaggccgtgatgcaccatgctgttgacgtccaggcgctggactgcgatttttacgttttctccggccataaactttacgggccgaccggcatcggcattctgtatgttaaagaggcgttgctgcaagaaatgccgccgtgggaagggggcgggtcgatgatctcgaccgtcagcctgacgcagggaacgacatgggcgaaagcgccctggcgttttgaggcgggaacgccgaatactggcggcatcatcggtctcggcgcggcgattgattatgtgacgtcgctgggactggataagattggcgattatgagcagatgctgatgcgctatgcgctggagcaactggcgcaggtgcctgatatcacgctatatggcccggcgcagcggttgggcgtcatcgcgtttaatctgggtaaacaccacgcttacgacgtcggcagctttcttgataattacggtatcgcggtacgaacggggcatcactgcgcaatgccgctcatggcctggtatggcgtgccggcaatgtgccgggcttcgctggcgatgtataacacccatgaagaagtggaccgactggtggcaggattaacgcgtatccaccgcttattgggataacagtgaggttttatggctgcgctaccggataaagaaaaattgctgcgtaactttacgcgttgcgctaattgggaagagaaatatttatatattattgagttggggcagcgcctggcggagttaaatccgcaggatcgcaatccgcaaaatacgattcatggctgtcagagccaggtgtggatcgtgatgcggcgaaacgccaatggcattatcgaattgcagggcgacagcgacgcggcgatcgttaaaggccttatggcggtggtatttattttgtaccaccagatgacggcgcaggatattgtgcattttgatgtccggccatggttcgaaaaaatggcgcttacgcaacacctcacaccttctcgttctcaggggctggaagcaatgattcgcgcaattcgcgctaaggccgccactcttagctaaactatacagacagcgttctacctgatgtcaaatcctttgtcggacggcgacgtcgctttatccagagtggacagagcgtatattttgttgttctgataagcgaagcgctaccagccgtcgcagagggcatcaccaggaatacaggaggtttggtatgaaacgtgcgtctttcattacgctaactattatcggcgcgtatagcgcgttacaggcagcctgggcggttgattatccattaccgccagaaggcagccgtcttattggtcagaatcaaacctataccgtacaggaaggtgataaaaacctgcaggctatcgcccggcgttttgatacggcggcgatgctcatccttgaagcgaacaatacgattgcgccggtgcctaagcccggtacgctaattaccattccctcgcagatgctattgccggatgcgcccagggaaggcgtcatcgtcaacctcgcggagctacggttgtattttacccgccgggagaaaaccgcgttcaggtgtatcccatcggcatcggtttgcagggactggaaactcccgtcatggacacccggatagggcaaaagatccccaacccgacgtggacgccgacggcaggcatacgccaacgttcgcttgagcgggggatcacgctgccgccggtgatccctgccgggccaaataacccgctgggacgctatgcgctgcgtctggcgcacggtaatggggaatatctcattcatggcaccagcgcgccggatagcgtaggtctgcgcgtgagttccggttgcattcgcatgaacgcgccggacatcaaagcgttatttgcgcaggtcagaacggggacgccggtaaaagtgattaaccagccggtgaaattctctgtcgagccgaatggcattcgttatgtagaggtacacaggccgctatcgccggaagaagagcaaaacgtgcagacgatgccctatgtgttgcctgcggaatttaccgcgttcagaaacgcgcaaggggtggatagtcgcctggtcgataaggcgctataccggcgagccgggtatcctgtcagcgtgagcgccggacagacgccagcggtaaatacgaccgcagtcgaatccgctcagaacggttttgtcggggaagaggggcaaacgcgcgcgacgcagtagccttcgcagtaaatgacggacaaaaaaatggcgcacgatgtgcgccattttatatcatgcgtcaaatcatttacagatgcggaatactttgttgtccagacgttggttagcgcgagctgcgtcgtctttagcagcctgaacgtcggaacgcattgcatttacgtcattactcagttgatcaactttagcgctcagcgtctgtacatcggaagacaactgatcgattttagcgttgctggaacaacctgccagtaacgtggaacccagaactactgcacctaagatcagtttgttagtgcggttcataacaataaccttatattttgtgtggttatataggtaaaaaaaatggcgcacgatgtgcgccatttttattacgcaggtactattacttacggtatttagtagcctggttgtccagacgctggttagcgcgagctgcgtcgtctttagcagcctgaacgtcggaacgcattgcgttcacgtcgttgctcagctggtcaactttagcgttcagagtctgaacgtcagaagacagctgatcgattttagcgttgctggagcaaccagccagcagagtagaacccaggattaccgcgcccagtaccagtttagtacgattcattattaataccctctagattgagttaatctccatgtagcgttacaagtattacacaaacttttttatgttgagaatatttttttgatgggaatgcacttatttttgatcgttcgctcaaagaagcatcgaaatgcatgaaagtccctaaaaaaccgaaagaaaacagggggcttccatcggattcttcttagataatccgcaattagatagtaaaatccgatttgatttttttattaatagtggctatcgattaaataaaaaaagcgccggaagggcgcttttttaaacaaattaattcacacaacaattattacagtacgtgaacagaggcggtgttagtggtgccgcttggaaccagcgcgccggagaccatcactacgacgtcgcctttctgggcgaggccgctttgtagggcgacatctttgcccagacggtagaaatcatcagtagaattgatttctttcaccagctgcgataccacgcctttgctcagtactaactgacgggcggtcacttcattggtggtcaatgccaggatggtggcgtccgggaagtatttacgcacggcgcgagcggatttaccgccctgggtcgctaccacgatcagcggcgcttccaatttttcggcggtttctaccgcgccgcggcataccgcttccgtaatgcgcagtttacggctgtcgttgttgtagtccagacggctgttcatgacgcggtcggtacgttcgcagatggtcgccatgatagaaacggcttccagcgggtatttcccttttgcggattcgccggacagcataaccgcatccgtaccgtcgaggatggcgtttgcaacatcgcctgcttctgcgcgggtcggacgcggatttttgatcatagaatccagcatctgagtcgcggtgatcacgactttacgtgcgcggatacatttttcgatcatcattttctgcgcaaagatcacttcttcaaccgggatttctacgcccaggtcgccacgcgcaaccatgatgccgtcggaagcttcgagaatttcatcgaagttgttcaggccttcctggttttcgatcttagagataatctggatgttttcgccgccgtgggctttcagatgctcgcgaatttcgacaacgtcagaacgtttacggataaaggacgcagcaacaaagtcaacgccctgttcgcaaccgaagatcaggtcctgtttgtctttttcagccagcgccggcagagcaatagaaacgcccggcaggttaacgcctttgttctcgcccagatcgccgttgttcagcaccttacaaatgactttattgccttcgatggcggtcacttccataccgatcagaccatcgtcaaccaggacggtgttgccaacgctcaggtcgctggtgaagccttcataggtgacggcaacgatttcattattaccgaccacggatttgtcggtggtaaaagtaaaggtttggcccgctttcagcgaaacgtcgttaccgccttccagtttaatggtgcggatttctggtcctttagtatcaagcagaatagcagcttttttaccagttttgctcatcacgttgcgcaagttctggatacgctgaccgtgttctgcataatcgccatgagagaagttcagacgcatcacgttcatgcccgcgtccagcattttgcttaacatctcttcggattcggttttcggaccgatagtacaaacaattttcgtctttttcatgacagtcttagtctttaagttgaggaggatatggaaatctggcttcgggcgcgcacggcccgtaagctaagcctgtgttgctaaagtgatgatgcctcgctctaaggataggtgacatcgaaagagcgtgcagaggaatgtgtgctcgcgtttcagcccaacgggaaggggataattttagtcgttgagttttacagtccaatgcgctgaaaccattcaagagacaattggcgcgcattatacgctgaaatttacaaaaaaggaaaatgaaaaccctgtttcaaaagacatctgtgcagatccacaacggtttgttattacgctgtttacgatgtcgctggcgatgacgccgcccgaacaggggcggcgttgcgcaacagctggtgttgttgcgcataatgtcaatcgagcaactttttgccttccaggtcgatggcgatgttttggttgtatgcttttcggtagcacagtatcgctatcccgatcgccgcccagctaattccgagtatcagagcgtgaatgttcatgtttaaacagacgtagccgatgacgatcatccccatgatcggcgaaatgacatgggcgaaaatgcgccgctgggctttcatccggaaattgaacaggataaacacacacaggttcacgacaaaaaaagcgaaaagcgcgccaaagttcaccagcgtggagatagattcaatcttgccggaaaacaggtagctgagcagcagggtgacgccgccggtaaacagaatggcataatccggcgttttacgcgtggtatggacgtgagcgaggaaggcgggcaacattcggtcgcgccccattgaaaataacactctggacaccgccgtttgcgcggtaataatgttgccgacggcgcacacaaacgccacaatgatggaaaacgccactttgagccagataccgccaacgttgccggcaatggtgaaaaatgcttcattcgtcgcattaccttccgcgaagcggtcgacgttaccggtggcgaacgccgcaaacgccacaacgataataaacagtaccgtcgccaaaactaacgccaacagtgttgctttactgacggcgcgtcccccgccttcgctttcttcacttaatgtactgatagcgtcaaagccgagaaaattcagcgcagccaccgaaatcgccgttgcgatgagcccaggggtgaaccactgtgaatcgaaaaaaggccggaaggaaagcgttatctgactactgtcctgcatcatcagacggataatgagtagcacgaaaatcgccagaataccgagttgaataaagaccagtaacttatcgaatttcgccgtttgctgtatcccgagatagttgactccggtgccaatagccacataaatcaacggccagacccagaccgggatttgcggtaaaatagcgtggaccgcgacaccgcccagcaccgctacgagcgtagggaacaaaagataatccagcagtaatatccatccggtcagaaaccctacggcgggattaatgcatacgccagcatacgcataggccgaacccgacgaggagatatgctgcgataaggtagagtagctgtacgcggtaaaaaacatcgcgatagcgccaataatataaaccagcgcaaccataccgtgcgaaagattataaacgacgccataaagagagactggtgcgataggcaccataaacaccagaccataaagcactaaatcggtaagagacaattttttgacttttttcatgataaatatcttaatggctttttatgccagatcgcgtaaaaacgcgcttacctctgcgaggcagggcgcgatattttcttcatgcgggttatggctgctgccaggaatagtgaccgcgcggcagtctgaaatgtgagagagcagcggagagacgacgcgctcggttgcctgatcgttttcgccgcgtagtaccagaacaggacagcgtatctggcacaaatggggcgtaatatcccagtcggcaagtttgccatttgccgccagttcattggttccccataaaatgtgataacccgtagggtcggcggcgaactggccagtatcgtcccgcgaagcccggcaggctgtaagcaggcgtgctctgcggcaagcattccgccccaggaatgtcccagtatcgaatacccgtgcccaatacccaggtgatgaattaattgggttaattgacggagataacgcgcaatagtccagaaagacgcgtcggcatgaggaaaatgcgttgaacgaccgcaaccatattgatcgtaaaatattaccatgcgcccgtcatcagccagacggcgataatttaataaataatcaaagccgccagaagggccgccatgaaggataatgagcggcgtgagtaatgattttctgtcgccataaatccgatagcttgtcaatatgttttcagaaaacatttcgccatagagataagtatcattcatattcttaatgactcagtgtgtggcagggcaggcgaaatttatattcgcctgggtaatattatttttttattgtgtgtaaaacattacaccagaaggtggcgtaatgttcccattgcagaaactgcggacttccccagtgcggcgaacaatcactggcaaagcaacatactttccctttatggtaagtacccataactaacagtggatcgccattaatttcagcaaggacctgactattttctttggcgataagcttgttatagcccaacagcggcggccattcgctaaatggctgggtaataacatgttttaccgcagtatttactgctttacatccttgcggtagttctacgcggtcatctacatccagcatatcaaccggcaatacctccgccagaaccgtatttttataattggcttttgcttctattcccgtaaaggataaatacccgccgatcattaacagaccgccgccctcagcaacataatcggcgataagttgtaatgcatcaggaataatgtccatattataaaaggttctgttttgtaacaggaacgtattgctaccgatatcactgatgacgatcgcatcatagcaggctaatgcttcggcggtttgtggaaaacgagtttgcacaatatgggcaggcatgtagtccacatcgatattaccctggcgtaagcaggataataaatagtctgcgccttcttcgtatttgctcgatgtaaagctatcaaaacctttagagtgaatcatatgaatgtgccaggattcgccaataaataagattttcattatgtcacctgttaattaatgtgaatgactttattagattgggtacgcattcgatgtaaaacctgcaagtgctgaggcatactcgacgcaccgacttgttccaccgccagagaagcgaaagcggaggcatattgaatggctgcgaccatatctgcttgtcgcgccagcgcggcggctaaggcgccattaaaagcgtccggcggcatcttttaccacggcgctccacgcaggaatatacaacgtgcgggcgtgctcacagagcagagaaccacgggcgccaagggtaatgatgacttttttcaccccggattgcagaataatatttccggcttttttcgcatcattaatatcagtaatggttacgccggataaaaaagaggcttcagtttcattcggcgtgatgatgtcaatatcagataataaatgcgtcacctgtttcgtatagggggcaggattcagcatgatcattttattttcttgtttgcccaggcgaataaattcagtcaacgcttcaatgttcgtttcgagctgcattaacataacgtcagactcggcgatataacggtgttgctcgttaatctcttgcgtggtgagcatcatattggcgccagggtagatggcgataatattatcgccatccacggcggagacatagatcaatgcgctaccggtgggcgctttatctgtttgatacgcgctgtatgaggtggtgcctgattgaataatatgattcatagcaaatgcgctgaactgatctttgcccactttaaaaataaaatgcgccgcagcaccagcattgtttgccgctaaagcctggttggctcctttaccgccaggatagaatccaaattgactggccagaatggattctccgctttgtggaaaccacggcacggttgctgaaacatcaatattgaatgagcctaaaacacacaccttgcctgctttttttgtgttttcccggtgcagttttgcatcctgatggattggcgtggcgatagtgctggagatatcaatcttattttcagtgataagcttactcagcgcgtcacggtttaaaatccctccgccatagcaacgctgaagcatacctgatttctggaaatagcgtagatcggaacgaatagtctcctggctaaccttataaaggtctgaaagtttactgacgctaacactattatcctttatcagtaaattaatgatggcatgacgtctttcttctttaaacatattgcctccgggtagtgagttgaattgtatttatggcaatattgtcatgcggtgaattcaatcacagattatgcggtcaaccggaagtaatcccaaatgaatgtcaataatcagaagcgcagccaatgtgttaaatattaattgcttacagaaggggaaaatagttttgtgagtgttgtcatatattttctatgtaatatgacggggtgaacgtaaaatagttgggcttgcacgattcagtgagtatatgcagccggacagcattcgcttatcagtcgctaccctcgacgaaataagacgatatcgctctccggccctggggttatatacgctcgatttttgccggcagcccctgacgtaccgccgcgccagaaacccagtcgagccaggtgttggtaatggttcttgtcggatcagcaaagcccagatcgttaagatttatgcctgccctgatttgtggatcatacggcataggcacgccgtccagagagtgctgcgttgcgcccatctcgcggtggccatatccgtgttcgatggcgatgacgcctggcatcacgccatttaacaaactgatttgcgccacgacctgaccgcccggcgtaatgatccgtacccgatcgccatgttgcagtccataacgctcgccgtcttgcggattcagcgccaccaggtttgctggcttcacatggtgtaagcgcgggatgacggctgttgagctggacatggtatttgatttaaatgaaatcagtttcagcggccactgtccaatgggaaactggtcgtcaatcgcacgaccatctgacagacgcgccggataccagaccgggcaaccgctgaagcgctccccggtgatggcgtgacggtgggcggcgacatctgcattccagatctgtaagggttttttccacgcgttacctaaccgttgctccgtatagccgctatcttcgggcgcaaaccggccgccacgcgagtagataaacgccacgcgaccgacctcatcagctttaagcgtgtgctgaattgctggcagaatgcggctgacgccggtaagcgaaatatcttcctgatttgccagcgcgaccggcgtcttgcccataaaggcgatattagcggctacgcgcagatagaagtcttccgcccggttcagtggaaaagtattgccctgcggatcggttatcgcccggtcgccgaagccgggcagatggagccgttttgctaccgcaatacaaaatgcttccattgagacaggttgcccgtccgccgttcggtgagtggcgggggcgacaaccggccagcgggcggtagtggctttactggctacgccgccccagggcgccgtaaagccccagctctcaaaattgtgcgtatccggcacaatgtaatccgccagcgccgtcgtttcattcataaaggcgtcaatcgcgataaagagcggcagtcggcgagggtcttttagcttttcttccgccacggcgcgtagaccgggaacaccgtaaaacgggttgctcatattggaaatccaggctttaagcggataaggatagccttcgagcgcggaggtcaacagttcggtaagctggcctgccacaaagggataccatggcgctttggctggataaggggattgcccgccggcaattttgtcgcggtattcttccgatgctttataagcggttttgctacgggcaatactcaacccggacggtttcacttttccggcaaaactgttcatgttgtagcgggggccgtcgctaacgccgttgaatttgccgccgccgacaaagacgccgccggacaagctgaggttgccgatcagcgcgttaagcatcatgactgaccaggtgttataaaacccattgccggccatcatgccgccgtgactgatgaccgcagctttacgtccgtgactgataaaggtttccgccagcgcgataatttgcgcttccggcacgccgcactgttcgctgtattgcgccaacgagagcttttctgccgcctctttcaggcgttgcaacccgctcttcaccgtgacccgttggccgtcggcgagcgtaacgtactgcgtcacgaaaagccgtgcctgtcggcaagtggacgcatcgaccaactcgccgtcggtattcagcacgacgggggtctcttcgccatcgggcgtaagatggcgcagcgtcaggtgttgtccggcaagcgtcggcagttcatccgcaatgaccaggtgcgtggcgttggtccaactttgctcgccggcctgctgcatcgcctgtacgccgggaatcgccagataatcagcattataacgttgattatccatgatccagcggatcatccccattgccagcgccgaatcgctgccgggcatgaccggttgccagcgaccgcgaggatcggcgagcaccgttgataaggggagggcgggggcgaccacgacgtattgaaaattctcacgcagccgggcgctcgccaactgacgcgcctggcgtttaaagggattaccggactgtgccggggaggtgcccataaagagcgcaaactccacgttttcccagtcgggtttgacatgcgggtttttatccagatcgcccatcaatgccccggagccggcccggtaagccagtccacagtaggcgccatgcgcgccgaaattcttgctgccgaagctatttagcgcaaaacgacgcagaaacgcatcgcggccttcgtcgctggtattcgtgaccagtaactgattggttttgggcccgaaactggggtgctttgcgtcaattggcgtatccggcgcatgaatagcgcgcagtccgtccacatgaccttcgccaaacagatcgccgccttccacgacttcttcaataagctgctcaaagctgatgcgctgccatttcccttcgccgcgtttacccacgcgtttcatcggttcaagcagtcgcagcggactgtacaggctttccagcagcgtggcgccgcgcgcgcaggcggttgagcgggcgtcaagaccgctttctcccgccagttgctccatggcttcgctaaaagggacggacgagtcaatcgggtgttcctgcgacaaggggtgatagggattgccggcgatgcgtattactttgccatcggcatttacccgggcgcggataccgcactgtgtccaacagccgaagcattgcgtcatggcgatggtttgttgtggattttgctgccagtgcgtttgtgcctgcgcctccggaattaacgcgttgccaaagatgcggtcgcgcgttaccttgccggatgtcccgtttaacaggccatcaattgcgcgtttcgccacatcacggtagctcagaccaaaagtgaccatcccaccgacggcgagaccgacttttagccactgacgacgggttaaattagccatgttgtaatctcctggtgagtccgttcagcgtttcacgaatactaatcagtagcgctatccacaggccgaaggtgccgagaatagccagccagccatccgttccgcctggtaacgtgtaagggttaaattgcgcgttgaacttgggtacggtttgtacctgaatcaacaatgtccagcgcatcagccaacatagcgccagcgcgctcagaaccagcaggacgcgtcttagctccgataacggatgacgtagcgccaggctacagaacagcagtgtgaatacccacagcgctagccagccgacagcgtaatatttggctgacagggcgacggtaatccactgacggattgccgtgccggaaagcgtatcgccgctgacccacatggccacaaccagccccagcgccgccagcgtccagagttgtccccacagtatttttggcagccttaccgagtcgcgtcgggcggcgacaatcatcagcgcgaagaacgcctgtaaggcgctaagaaacatcgccacggggaaggcgtagctaaaccagattgggcgcgccagcacaacggagacttcgcggccggtataaatcaacaggcccaccgcgcaaagcgcgctggctaacgccaaccatttagtgacgttgtaacttttattgaataatcgttttatttgctgcgccaggaaccacagagcgagaaatccggtaaacagcggcaggaacaacgctccccagggcatccacgaccagggcgtcggccaggcatagaaatgccagacgcgggcggtctggtgcagatccgccgtcagcgccagcggtgcggtaatcgcacaggtaatggcaatcagtaatgcccgattttcttctgttgcggcgtcttttttccgccagtgaagataacaggcaaacagtgcggcgcaggcggcaatgccaataaaaaagaaatattgtaccgcccacggcagccagctaatgtcctgcgggtgagccagcacttcttcaatgatgagtgaatgcgtcattcagacctcctgccaaagcgcgggctgcgcacggcccattaatggggtgacaaaggcgtcgtccagacccaggtagaaaacatggggcgacgtgccgttttccggctttaataccttgatagcgtcgcgatgttgatgaagcatggtggcgatgcggctatggggatctttgatatcgccaataatacgcgcgccgccgacgcaggactctacgcaagcgggtaacagtccggcttccagacgatggacgcaaaacgtgcatttatcggcagtttgcgtttcatgattgataaatcgggcgtcgtaaggacacgcctggacacaataggcgcagccgacgcagcgtttgttatccaccaccacaatgccgtcttcccgctgaaaggtggcttgtaccgggcagaccggcacacagggggggttatcgcaatggttgcacagacgcggcaacagcacattcgtgacttcctgactaccttcacgctggacctggtattggttcacggtcgtacgaaacgcgccctgcggcgtttggttttcaatagtgcaacttacggtacaggactgacagccgatacaacgccgcaggtcgataagcatggcgtaacggtgtcggggagagccttcatgccgctccggcgaaaaaggaaatttcgcttcagccagcggaaccagcgaggcgccagcggtcaggacgccgagctgctggagaaattgccgtttactgctgtccatattgactcccgtccacattgccaacaatgaaacatttgtcacgatgttggttcatgtgtaatgaataaaaaatgttgatgatttacagtgtaaaaatcgagacggggtgcgctctattgtggttaaccacatacccggcttgttgttgatctaaaacaacataattgacagggatattggggtgagaggtaaaaccgtaaggcgcctggcggtgttggcggcagtagggctactttgtcatggcgcgtgggcagggacgtggaatatcggtattttggccatgcgcggcgaggcgtctacgcgtagccactggcaaccgttggcaaagacattaagccaacagcttccaggcgaaacctttcacatccagccgctggatctgcatcaaatgcaggaggccgttaaccagggaaccgtgcagtttgtgataaccaacccggcgcaatttgtccaactgaacagccatgcgccgctgcgctggttagcttccctgcgttccacgcgcgatgggaaagcggtgagcaatgttattggcagcgtgattttgacccggcgcgatagcggcatcaccacggcgcatgatctcatcggtaagacagtcggcgcgattgatgctcaggcgtttggcggctatttattaggctataaagcgctcagcgacgcgggcttacgcccggagcgcgattttcatcttcgttttaccggatttcctggcgatgccttaatctatatgctgcgcgaaaaagcggtgcaggcggcaattgtgccagtgtgcctgttagaaaatatggatcaggaaggattgattaataaaaaggactttatcgcgctgctttcccgaccgacgcccctgccttgcttaaccagtacgccgttatatcctgactggtcgttcgcggcgctacctgcggtaagcgatgcgctggcggatcgcgtaacgcgagcgctattcaacgcgcccgccgccgcgtcatttcactggggcgcgccagcgtcgaccagtcaggtggaagcgttgctgcgtgatgttcgtcagcaccctcagcagcgtcgactgtggctggatgtcaaaagttggttaatccagcaccagctaatggtcggcggcgtgattttggcgttcctgttgctcacgctcaattatatttgggtcatgctgctggtgcgtcgacgtggaaagcaactggaacgtaatagcgtagttcttcatcagcatgagcgggcgctggaaaccgcccggcaaatgagcgtgttgggtgaaatgacctccgggtttgcccatgagcttaatcagccgctttccgcgattcgacattatgcccaggggtgcctgattcgactgcgcgctgcagatgaacagcatcccttgctgccggcgctggagcagattgaccagcaggcgcaacgcggtgcggatactctgcgtaacctgcgtcactgggtcagccaggcgcagggcaacccggtgctaaccgaagcgtggaaggccatagccattcgcgaggcgattgatcatgtctggcaattgttgcgtatggcgcaacaatttccgacagtgactctgcataccgaggttagcgctgcgctgcgcgtaacgctgccgtcagtgctgctggaacaggtgctggcgaatatcattcttaatgcggctcaggcgggcgccacccatttatgggtcgttgctgaacgcactgaaaacggcatcagtattgttttacaggataacgccgggggaatcgacgaggcgctattacgtcaggcgtttcagccgtttatgaccacccgtaaagaggggatgggcttagggctggcgatttgccagcggctggtgcggtatgggcggggcgatatcagcatcaggaaccagaccgcgccggacggtctgtcgggaacggtggtcacgatacatttcttacatgaacatgggggcagggatggcgacaattcatctactggatgatgatacggcggtcactaacgcgtgcgcgtttttactggaaagtctgggatatgacgtaaaatgctggacgcagggggcggattttttggcgcaggccagtctgtatcaggccggggtcgtattactggatatgcgaatgccggtactggatgggcagggcgttcatgatgcgttgcgccagtgcggaagtaccctggcggttgtttttcttaccgggcatggcgatgtaccgatggccgtggagcagatgaaacgcggcgccgtcgattttctgcaaaaaccggtatcggtaaaaccgctacaggcggcgctggagcgtgcgctgacggtttcatcggcagcggtggcgcgccgtgagattatactgtgttaccagcagttgacgccgaaagagcgtgagctggccagcctggtggcaaaagggtttatgaaccgtgaaattgcggaagcgatgaatatcgcggtgcgtaccgtagaggtgcaccgcgccagagtcatggaaaaaatgcaggccggtagcctggcggaactgattaggcgtttcgaaaaaatggcctcgccagagaccagaatacgaacaacgtatgagccatgaataataaactgcgttatttctttgatttgcatcaaattttgtttaattgagaagactgttatattctgttggtttgagctggcgacgagtaaaacgtatgacaaaaccgacaaaagatgacgaactgtaccgcgagatgtgccgggtggtgggcaaggtcgtgctggaaatgcgcgatctggggcaggagcctaaatatattgttattgcgggcgtgttaagaaccgcgctggcgaatcaacgcatccaacgtagcgcgttagaaaaacaggctatggaaaccgtgattaacgctctggcgcggtcatagccgctatcagggtggcaataacgaaatcgcctttgaattgtcgcgattgtcaccatggcgggctggttacccgccgttagcgatgcgcagggttatcaggtgatggctaagcgcagccctaatgtatcagggtacggctcaaaataattctggctgcgtagatagtcatccggatgttccgccagatagtgcttcagcagcgttaacggtgccaggataggtagtcggcccgcccggtagccgagaatcacctcgcgtaattccgcgcgttgcctgctgttcaacgcgcggtgaaaatagccctggatatgcatcagcacattggtgtgatttttacgtgaagcggggtgtcgcaggatagccatcagtttttctctgtatcggacaaagaaggcatccagatcgtcccactcatgcagacgcgcgacgaaagggccaatttcgcggtagccggcctggtggtgggcgagaagctgaagtttgtatcggctatgaaacgcgagcaaactgtgacgactcaagccctgcgcgcgtagcgcatttaattcatgtagcgcgaagatacgtgcgatgaaattctcgcgtagtaccggatcgtgcaggcgaccatcttcctctatcggcagccagggatatttgtccatcatcgcggcggtaaacagccccgtgccagctttgcggcccctgttacccttttcatcatacaggcgaacgcgctccattccgcaactgggcgatttcgcacacacaataaaccccgccagttcgcctattgttggcagaaaccgatcggcaaaggcattcattcgctcggtgacgtcatcgtgcggggcatggctatagcgcatccgaatgtcgccacaggtcgtctggataagacgcagcgcagggcggggcacgggcaggccgatcgccacctccgggcagatcggtttgtaggccacccacggcgccagagagttcatgacaaaatccatacgcttatgtccgccatcaaagcgtaccgcggcgccagtcagacatccgctaatgccgactacgggtttgttattcatgattcccccttattgaaagtacgacgactgacgccaacggcgcaaaatgttatctcacgctgatttaaaacttacacaactttgtttttttgtctaagttttcgcggagatttttttgatgtacttaaatatcaataagatagaatgaggggaagaaatctatttcagcgcttatagtgtgataacctccagcgaagcgaccacgttgcgccactgggcaagctgttttttctgcccggcagtgagcttgccggtggtcaccaggaaccattttctctgggcgaacagctcgggcgccagaacggctggtggagagggaagcacattgagccgcagctcttgtccggtacgagtcaacgcttccagccagatttcacagtgatccgagagatgccatccgctaataaaagcattgttgccaggcgcttttctgtcgccttcaaggcaaaaagaggtgtaggcaataatgatgccatccaatatttcgcgcagcgtcatcacggcgggaagatgcgcggacactttgctgcgcaacggacgcaataaatgggtcaccagttctgcgcggggatattcccggccacagtcataaatcaactgccgcagcgcgtcaattcgcccttcgtggagatgttgaagcatcgtctcctgaatcgttatccagttatcgcccaggcgaatgaccggacgcgacagtaagggtttgacctgacttatcggtacgccttttctcacccagtcgaggatgctaagcgcttgtcgaatatcgtcatcgctgtataagcgatgcccgccatcagtacgctgcggtttcaataaaccatagcgtcgctgccatgcccttagcgtggcggcattgataccgcatagtctggcaaattcgccgatagaatacgacatggtaaagcccgttaaataaggggattctactatatcatgattaaatgaagactaaggtagtgataaatggtgcggcataccagggcatccgtatggattttgtcgatgatgagcaatactgcgtggcgtaaggctcatcaaaatatgaccaatgcttaataccatcggatgcccctggttaatactctattaacctcattcttcgggcgcagttaagtaactctgtcactttatgaacctgtagctttctcatcatattcatccgatgtgtttcgacggtttttatactgatatgtagcttttcgctgatcccatgattggtatacccctcgtcaataagtttaagaacctgacgctcgcgcaaagtaagcagttgatgattggtcgtgtcagcgtttaattcagccaggatagcttcccgattcaacgtcgggtcaatgtaacgcttgtttactgcgactgtttgcaatgccgctaacaggacttgctgactactgctttttaaaacatagccattagcacctgcggctaaagttttaatggtcatatactcttgttggtatgctgtgtaaaccagaatattcattgctggccaacgctgatgtaattgaggaatgatatccaggccattgatgccaggtaagctaagatcaaggataagtatgtcaggctcgtatgcgcaacaggcattataaacctcaagaccatttttaacatgctctacaattttaaaatgaggccagggtaataaggcattcataatgccgttaatgatgatttcatgatcgtctactaataagatcttatattctttcattttgctgccctcgcgaaaattaagataatattaagtaatggtgtagtttttgaagatcatacgtattttctggcgtaagtcggttagttcttccagcgcgatgattttccccatttttacgcgattctcaatgtctatgacatagcataccaattcagtctgccctatttgacctaaacagccttttaatgtgtgaattaactgatcgattttttttccagccgatacggcattttcaatatcagccagcaagaggtccagtgattggaaaatcttgctattaatgaccatatcatctgtcgccagtagcgctgagcagcgacttggatcctgctcctgtagctctatatttcgtaaaagttggtattctgcggcaatactgatatagcgagctaaggtagccaacgtcactggtttggtaatgtaatgatgaatcccattttttttacaacgatgaatatcttctgtcgctacgctagcggatagcgccacaaacatgcagtcaggatctaaattattcggctcatcgtgccataattgtacacattcaataccatctatttctggcattctaatgtcaatcagtactaaatcgaatcgttgctgttgtgataaagtcagagcctcgttactactggcggcaatagtgacgtgttggcccaggctgacaagcattttgccgatgatatcccgattaatatcggcatcatcaaccaaaagaatctgtaactgccagggtggtaacaaattatttattattggtatatttggtgtacacaatattaactgttgcgccaggtcgtagagttttccggggaaatacaaaagctcagcgttgagaagcgcattttgctggtggggtggttcgccgcgtattccccagcaagccagttggcgatgcaggcagaacggcgctgacagtgtccctttaatttgttgaggcggttggtattcttgtaagggtaatactagcgagacacaggttccaaccccggggacactttttagtgtcagattaccgcccatcattttagccaggcttgacgcaatagtcagtccaattcctgtaccttgcgaatttgtgtctgcttgataaaaagcagtaaagatttgagactgctgctgtatttcaatccctttaccgctatcgctaaccagaaatattaattgttcctcatgacgcttgaccgtcagacgtatccctccggtttcggtaaattttaccgcgttcccgagtaaattaaccaaaatttgccgtaaacggatactgtcggtatgaaaatagagggggacatgttgaccaacaaaagtacgtaatgacagttttttgctttgtgctggcccctggatggtttgcattgcctggtccagtaacggcagtaacgctgtttcttccatatgtaatgtgaaatgaccagactcgatgcgtgaaaaatccagcagattattaataatagctaacaaagacagtgtgcaatttctggcggtatcagctaatccttgctgctctatgtttaaaggggtggtttgtaataattcaattgcaccgagtacgccattcatcggagtacgtaactcatgacttattaccgtaagatgaatgcttttacgtttgttagcttgctcagcgcgtttttttgcttcatttagcgcctgggtgcgctctgcgactttgttttccagattgtcgtattggacttgtagggtatcaagtagttggttaaaagcaccggcaatactatctaattcatccagtcgttgtgctggtaaacgtgtgctcagcggtgcagttgcggttttattaatgatatcgacaaaacgccataacggtttggccagtgagcgatgtagtaaccagcaaaaagccgacgtcatcaacaccaatgctgttaatgtaaaggggatttgttggaggatagtttttaagatgcgattatgtagattaccgtatgggtacagcgtaaccagactccatccggggccatgcaaagttgtgcgtaatatcagaaatccgggaatttgttgccatccatcatgcagcgttacattttctaactgtgtacgtattttttgcgggatgtatgaaaacggcaataagtggttgttttgatccagccatactcgaatactatcatctaatggtaggtggctcttagaaatgagatcaggaagtttaaccatcaccccaaaaaatacgccttgctgatcggcaaccgcaacggaagcgtgccatcctttgccgtttatgtattctggttcactccagtaaaacccggcatgggttgggtataaaggaaagctttttcgcgttaaaagctgtagagttgaataatctgaagggttatcagtagataataacgaaatctcatttttatggttaagaataaaactatcgcgacgaaagcttttttcatcgatatcagaggactgcagaaagagacgatgcttctctccgtttagcgtcggcgtgcaatttgaaggaccgacagaaagatgccggctcacctcagggaaaatatcattatgatgaatctcagtcgctaatgagcattgatacattaaatttttagcgtcacgttcagcctcttcaaatcgttgattgcttagtacaatattcatctcggatagagcggataaatcctctattatatgctgccgtttctgaaccattgatatataagctgcagtaatcacagatagcagccaaataattatggttgttaataaaaataaaaaagttagcctgattactaaagatgtttgcagcgtattcttgagattgagcaaattcataatgctttcctccagttgcctgttgcaaaatctttggcacttgatcactatcgcagtacatatagtttcatcagaagattaatcgatggtgttatcattaggaagataaatttcttcatatataaaccagtcgatgactacaattactttttaataaggcagcgatgtaaaaacatcgtaacagtttatttaataaataatttttcaaattgtaagtttttgtgtctatgctgaaaatgtaattgtgaatttatcggaaaatccgaatgatagaatcgcctgtgacaaggtatatgtagacagcatcctgatattgtacaagaagagtatagtcgaaataaatgtgaatcaggctttttacggatgtggttgtgagcgaatttgatagaaactcccatttatgtctgaggagggattcatgctggcagttttaaaaggcattccattaattcaggatatcagggccgaaggtaatagccgatcctggataatgactattgatgggcatcctgccagaggagaaattttctcagaagcattttctatttctttgttcttaaatgacctggaaagcttacctaagccttgtcttgcctatgtgacactactgcttgcagcacacccggacgtccatgactatgctatacagctcacagcggatgggggatggttaaacggttattataccacaagtagtagctctgagcttattgctattgagatagaaaaacacctggctttaacttgcattttaaaaaatgtaatacgcaatcaccataaactttattcgggtggggtataaaatggtagtaaataaacgtttaatcttaattttactatttatactcaatacagcaaagagtgatgagttatcatggaaaggtaatgacttcaccctttatgccagacaaatgccattagcagaggttttacatctgctctcagagaactatgatacggctattactattagcccattgataacagctacatttagtggaaaaattccgcctggaccaccggtcgatattttgaataacctggcagcacaatatgatttgctaacctggtttgatggcagcatgttatatgtatatcctgcatcgttattaaaacatcaggttatcactttcaatattttatctactggacggttcattcattacttacgcagccagaatatcctttcatcaccgggatgcgaggttaaagaaattaccggtaccagagctgtggaggtgagtggtgttcccagctgtctgactcgtattagtcaattagcttcagtgctggataatgcgttaatcaaacgaaaagacagtgcggtgagtgtaagtatatacacgcttaagtatgccactgcgatggatacccaataccaatatcgcgatcagtccgtcgtggttccaggggtcgtgagtgtattgcgtgagatgagtaaaaccagcgtaccggcgtcatcgacgaccaatggttcacccgctacacaggcattgcccatgtttgctgccgacccacgccagaatgcagtgatcgttcgtgattatgcggccaatatggccgggtatcggaaactcatcacagaattagatcaacgccagcagatgatagagatttcggtgaaaattatcgatgttaatgctggagatattaaccagttaggcatcgactggggaacggcagtgtcgctgggtggcaagaaaattgcgttcaatacaggtttgaatgacggtggtgctagcggtttttcaacggtaatcagcgatacctcaaactttatggtgcgtttgaatgccctggaaaaaagctctcaggcttatgtactttcccagccatctgtggtgactttaaataatatccaggctgtgctggataaaaatattactttctataccaaactgcagggagaaaaagtggctaaacttgaatccatcactacgggttctttgttgcgcgttacacctcgcttgttaaatgacaatggcacgcaaaaaataatgcttaatcttaatattcaggatggacaacaaagtgatacgcaaagcgaaacagatccgctacccgaagtgcaaaattctgaaattgcttcgcaagccacattattggccggacaaagtctattgctgggagggtttaaacaaggtaaacaaatccactcgcaaaacaaaatccctttattgggcgatatccctgtcgtaggtcatttgtttcgcaatgatacgactcaagtacatagtgtaatcaggctttttttgattaaagcctcagtagtaaataatggcatatctcatggttaatccaaagagttcctggaaaatacgttttttaggtcacgttttacaaggccgggaagtatggctgaatgaaggtaacctgtcactgggggagaagggatgcgatatttgtattccgctggctataaatgaaaaaattattctgagagaacaggcagatagtttatttgttgatgccgggaaagccagagttagagttaatggccgcagatttaatccaaataagccgctaccatccagtggggttttgcaggttgcgggagtggctatcgcgtttggtaaacaggattgtgaacttgctgattatcaaatacccgtttccagatcagggtactggtggttggctggcgtattcttgattttcatcggtggaatgggtgtcctgttaagtattagtggtcagcctgaaacggtaaatgacttacctttgcgggttaagtttttattagacaaaagcaatattcattatgtgcgggcgcaatggaaagaagatggaagcctgcagttgtccggttattgctcgtcaagcgaacagatgcaaaaggtgagagcgactctcgaatcatggggggtcatgtatcgggatggtgtaatctgtgatgacttattgatacgagaagtgcaggatgttttgataaaaatgggttacccgcatgctgaagtatccagcgaagggccggggagcgtgttaattcatgatgatatacaaatggatcagcaatggcgtaaggttcaaccattacttgcagatattcccgggttattgcactggcagattagtcattctcatcagtctcagggggatgatattatttctgcgataatagagaacggtttagtggggcttgtcaatgttacgccaatgcggcgctcttttgttatcagtggtgtactggatgaatctcatcaacgcattttgcaagaaacgttagcagcattaaagaaaaaggaccccgctctttctttaatttatcaggatattgcgccttctcatgatgaaagcaagtatctgcctgcgccagtggctggctttgtacagagtcgccatggtaattacttattactgacgaataaagagcgtttacgtgtaggggcattgttacccaatgggggagaaattgtccatctgagtgccgatgtggtaacgattaaacataatgatactttgattaactatccattagattttaagtgagtggaaaatgacaactctgacccggttagaagatttgctgcttcattcgcgtgaagaggccaaaggcataattttacaattaagggctgcccggaaacagttagaagagaacaacggtaggttacaggatccgcagcaatatcagcaaaacaccttattgcttgaagcgatcgagcaggccgaaaatatcatcaacattatttattatcgttaccataacagcgcacttgtagtgagtgagcaagagtaaagtaaaaatatcttagagcctatcccaccaggcgttaattggcgcagccagtttggacacggatagcgcgcaaaaaccggagcgtacacgtagtacgtgaggattttgagcactgcccaggttcaaaatggcaagtaaaatagccctaatgggacaggctcttagttagcacgttaattatctatcgtgtatatggaggggaatgatgataaagaaaaaggctgcgtttagtgaatatcgtgatttagagcaaagttacatgcagctaaatcactgtcttaaaaaatttcaccaaatccgggctaaggtgagtcaacagcttgctgaaagggcagagagccccaaaaagagcagagagacagagagtattcttcataacctatttccacaaggcgttgccggggttaaccaggaggccgagaaggatttaaagaaaatagtaagtttgtttaaacaacttgaagtacgactgaaacaacttaatgctcaagccccggtggagataccgtcaggaaaaacaaaaaggtaaagcataatgtcttcaggaaacatcttatggggaagtcaaaaccctattgtgtttaaaaatagcttcggcgtcagcaacgctgataccgggagccaggatgacttatcccagcaaaatccgtttgccgaagggtatggtgttttgcttattctccttatggttattcaggctatcgcaaataataaatttattgaagtccagaagaacgctgaacgtgccagaaatacccaggaaaagtcaaatgagatggatgaggtgattgctaaagcagccaaaggggatgctaaaaccaaagaggaggtgcctgaggatgtaattaaatacatgcgtgataatggtattctcatcgatggtatgaccattgatgattatatggctaaatatggcgatcatgggaagctggataaaggtggcctacaggcgatcaaagcggctttggataatgacgccaaccggaataccgatcttatgagtcaagggcagataacaattcaaaaaatgtctcaggagcttaacgctgtccttacccaactgacggggcttatcagtaagtggggggaaatttccagtatgatagcgcagaaaacgtattcatgaaaaaagacccgaccctacaacaggcacatgacacgatgcgatttttccggcgtggcggctcgctgcgtatgttgttggatgacgatgttacacagccgcttaatactgtgtatcgctatgccatgcagcttatggaggtaaaagaattcgccggcgcagcgcgactttttcaattgctgacgatatatgatgcctggtcatttgactactggtttcggttaggggaatgctgccaggctcaaaaacattggggggaagcgatatacgcttatggacgcgcggcacaaattaagattgatgcgccgcaggcgccatgggccgcagcggaatgctatctcgcgtgtgataacgtctgttatgcaataaaagcgttaaaagccgtggtgcgtatttgcggcgaggtcagtgaacatcaaatcctccgactacgtgcagaaaagatgttacagcagctttctgacaggagctaaaaatgaatcgaattcacagtaatagcgatagcgccgcaggagtaaccgccttaacacatcatcacttaagcaatgtcagttgcgtttcctcgggttcgctgggaaagcgccagcatcgtgtgaattctacttttggcgatggcaacgccgcgtgtctgctatccgggaaaattagtcttcaggaggcaagcaatgcgttgaagcaactgcttgatgccgtacccggaaatcataagcgtccatcattgcctgactttttgcagaccaatcccgcggttttatcaatgatgatgacgtcattaatactcaacgtctttggtaataacgctcaatcgttatgccaacagcttgagcgggcaactgaggtgcaaaatgcattacgtaataagcaggtaaaggagtatcaggagcagatccagaaagcgatagagcaggaggataaagcgcgtaaagcgggtatttttggcgctatttttgactggattaccggcatatttgaaaccgtgattggcgccttaaaagttgtggaaggttttctgtccggtaatcccgcagaaatggctagcggcgtagcttatatggccgcaggttgtgcaggaatggttaaagccggagccgaaacggcaatgatgtgcggtgctgaccacgatacctgtcaggcgattattgacgtgacaagtaagattcaatttggttgtgaagccgtcgcgctggcactggatgttttccagattggccgtgcttttatggcgacgagaggtttatctggcgcagctgcaaaagtgcttgactccggttttggcgaggaaatggttgagcgtatggttggtgcaggggaagcagaaatagaggcgttggctgaaaagtttggcgaagaagtgagcgaaagtttttccaaacaatttgagccgcttgaacgtgaaatggtttcgccgggcgagatggaagaggagtctgccgaattttctcgtaacgtagaaaaaaatatgacaaaaaatgcgggaaaaagttttacgaaagagggggtgaaagccatggcaaaagaagcggtaaaagaagccctggaaaaatatgcgcaagaaggggaaaagtttctgttaaaaaattttcgtaataaagttctcttcaatatgttcaaaaaaatcctgtatgccttactgagggattgttcatttaaaggcttacaggctatcagatgtgcaaccgagggtgccaatcagatgaatactggcatggttaacacagaaaaagcgaagcttgaaaagaaaatagagcaattaataactcagcaacggtttctggatttcataatgcaacaaacggatgaccaaaaaaagatagaacaaaaacgcttagaggggctttataaaggtagcggtgccgcgcttagaggtgtattagataccattgatcactatagtagcgttcaggcgagaatagctggctggcgcgcttaatctgaggataaaaatatggaagcgagtaacgtagcactggtattaccagcgccttccttgttaacgccttcttccactccatctccctccggggagggaatgggtactgaatcaatgcttctgttatttgatgatatctggatgaagctaatggagcttgccaaaaagctgcgcgatatcatgcgcagctataacgtagaaaaacaacgactgtcctgggaactgcaagtcaatgttttgcagacgcaaatgaaaacaattgatgaagcgtttagagcatcaatgattactgcgggtggcgccatgttgtcgggagtgctgacgataggattaggggctgtaggcggggaaaccggtcttatagcgggtcaagccgtaggacacaccgctgggggagtcatgggcctggggtccggtgtagcgcaacgtcaaagtgatcaagataaagcgattgccgacctgcaacaaaatggggcacaatcttataataaatccctgacggacattatggagaaagcaactgaaattatgcagcaaatcatcggcgtggggtcgtcactggttacggttcttgctgaaatactccgggcattaacgaggtaaatatggtgcaagaaatagagcaatggttgcgtcggcatcaggtgtttactgagcctgcatatttaggggagaccgccatattacttgggcagcagtttatattatcgccttacctggtgatctatcgtattgaggcaaaagaaatgattatttgtgagttcaggcgcctgacgcccgggcaacctcgaccacagcaattgtttcacttactgggacttttacgcgggatatttgtgcatcacccgcagttaacatgtttaaagatgttgataatcaccgacgttctggatgaaaaaaaagctatgctacgcaggaaattattgcgcatcctgacagtaatgggagcgacctttacacagcttgatggcgataactggacaattttatccgccgagcatcttatccagcgacgtttttaaatgaccttcctggcgtaaatcattatcacgtgaaaataacaatcaataggtatgatgatgaaagaagatcagaaaaataaaatacccgaagacattctgaaacagctattatccgttgatccggaaaccgtttatgccagtggttacgcctcatggcaggagggggattattcgcgcgccgtaatcgattttagctggctggtgatggcccagccatggagttggcgtgcccatattgcattggctggcacctggatgatgcttaaagaatacacgacggccattaatttctatggacatgccttgatgctggatgccagccatccagaaccggtttaccaaacgggcgtctgtctcaaaatgatgggggaacccgggttggcgagagaggcttttcaaaccgcaatcaagatgagctatgcggatgcctcatggagtgagattcgccagaatgcgcaaaaaatggttgatactcttattgcttaaataacagaacgaaatatgaaaattcatattccgtcagcggcaagcaatatagtcgatggtaatagtcctccttccggtatacaagcgaaggaggcatcgtttcctccccctgaaattccagcccctggcacccctacagttcctgtggtgcttacgcctgaacaaataaggcagcagagggattatgctatacattttatgcaatacacgattcgtgcgctgggggcgacagtcgtgtttggattatcggttgctgcagcggtaatttctggcggagcaggattacccattgctattcttgcgggggcggcgctcgtgattgctattggggatgcttgctgtgcgtatcataattatcaattgatatgtcagcaaaaggcgccgttacaaaccgccagtgatagcgttgctcttgtggtcagtgcgctggccttaaaatgcggggcaagtcttaactgcgctaacacccttgctaattgtctttctttattaatacgttcaggaatcgctatttctatgttggttttacccctacagtttccactgcccgcggctgaaaatatagcggcctctttggacatggggagtgtaattacctccgttagcctgacggcgataggtgcggtactggattattgccttgcccgcccctctggcgacgatcaggaaaattctgttgatgaacttcatgccgatcccagtgtgttattggcggaacaaatggcattgctctgtcaatctgctactacacctgcattaatggacagttctggtcatacatctcggggagaaccatgaaacctgttagcccaaatgctcaggtcggagggcaacgtcctgttaacgcgcctgaggaatcacctccatgtccctcattgccacatccggaaaccaatatggagagtggtagaattggacctcaacaaggaaaagagcggttattggccggacttgcgaaacgagtgatagagtgttttccaaaagaaatttttagttggcaaacggtcattttgggcggacagattttatgctgttccgctggaatagcattaacagtgctaagtggtggaggcgcaccgctcgtagccctggcaggaattggccttgctattgccatcgcggatgtcgcctgtcttatctaccatcataaacatcatttgcctatggctcacgacagtataggcaatgccgttttttatattgctaattgtttcgccaatcaacgcaaaagtatggcgattgctaaagccgtctccctgggcggtagattagccttaaccgcgacggtagtgacgcattcatactggagtgggagtttgggactacagcctcacttattagagcatcttaatgatcttacctacggactaatgagttttactcgcttcggtatggatgggatggcaatgaccggtatgcaggtcagcagcccattatatcgtttgctggctcaggtgacgccagaacaacgtgcgccggagtaatcgttttcaggtatataccggatgttcattgctttctaaattttgctatgttgccagtatccttacgatgtatttattttaaggaaaagcattatggatattgcacaattagtggatatgctctcccacatggcgcaccaggcaggccaggccattaatgacaaaatgaatggtaatgatttgctcaacccagaatcgatgattaaagcgcaatttgccttacagcagtattctacatttattaattacgaaagttcactgatcaaaatgatcaaggatatgcttagtggaatcattgctaaaatctgaagttattagcgacgatgttcgacggttgctgctggaaatcatgtttgcgggcgttaaccatagcctgatttcccaggtacatgcgatgttaccagcgctaacggttattgttccggataaaaaattacagttggtatgtttggcattattgttggcgggtttaaatgagccgttaaaggccgcgaaaattttatcggatattgatttgccagaggctatggcgctacgaatgttatttcctgcaccaaatgaggggtttgaaaattgaatatttctgatatgagcatagtgcctgtaagcactcaatcttatgtaaagtcctttgcagaaccgagccaggagcaaattaatttttttaaacaattgctgaaagatgaagcatccaccagtaacgccagtgctttattaccgcaggttatgttgaccagacaaatggattatatgcagttaacggtaggcgtcgattatcttgccagaatatcaggcgcagcatcgcaagcgcttaataagctggatagcatgacatgaaggttcatcgtataatatttcttactgtccttacgttctttcttacggcatgtgatgtggatctttatcgctcattgccagaagatgaggcgaatcaaatgctggcattacttatgcagcatcatatcgatgcggaaaaaaaacaggaagaggacggtgttaccttacgtgtcgagcagtcgcagtttattaatgcggttgagctacttagacttaacggttatccgcatcggcagtttacaacggcggataagatgtttccggctaatcagttagtggtatcaccccaggaagaacagcagaagattaattttttaaaagaacaaagaattgaaggaatgctgagtcagatggagggcgtgattaatgcaaaagtgaccattgcgctaccgacttatgatgagggaagtaacgcttctccgagctcagttgccgtatttataaaatattcacctcaggtcaacatggaggcctttcgggtaaaaattaaggatttaatagagatgtcaatccctgggttgcaatacagtaagattagtatcttgatgcagcctgctgaattcagaatggtacctgacgtacccgcgagacaaacattctggattatggacgttatcaacgccaataaagggaaggtggtgaagtggttgatgaaatacccttatcagttgatgttatcgttgacaggactgttattaggagtgggcatcctgatcggctatttttgcctgagacgccgtttttgagccgacctgatcccgaagtgttgcaactttatcgttatttctggcaacctgctcgttacgctgtaccggaatggctggataagctgggctttcatctttcaaactgctggcgttatggcgatcggcccaaattggatcgtcttcttgacagagcgttaaatagactaaggggaagctctgttattccagcctgtttaaatgacaggcaaaaacgacagattcgtcttgcgccgcgtatatcggcatttgcctttggactgggattattcaaactcaggtgtagtgactattttatgctaccagagtatcggcaattgcttctacagtggtttagcgaggatgagatctggcagctatatggttggttggggcaaagagatggcaaattacttcctccgcaagtgatgcaacaaactgcattgcagatcggtaccgccattcttaatcgggaagcgcatgacgatgcggttttacatgcgctattagtattattaccccctccgcagcgtatactttggccgaagacttctcttaccgagattatcttcatggagcatttgctatgagttttacttcacttcctctgacggaaattaaccataagctacccgctcgaaatattattgagtcacagtggataacattacaattaactttatttgcacaagagcaacaagctaagagagtttcacatgctattgtgagctccgcttaccgtaaggctgaaaaaatcatccgagacgcctatcgttatcagcgtgaacagaaagttgagcagcaacaagaaatagcgtggttgcgtaaaaatacgctggaaaaaatggaagtagaatggctggaacaacatgtaaaacatttacaagaagatgaaaatcaatttcgttcattggtcgatcacgccgcgcatcatattaaaaatagtatagaacaggttctgttggcctggttcgaccaacagtcggtagacagtgttatgtgccatcgtctggcacgccaggccacggctatggcggaagagggagcgctttatttgcgtattcatcctgaaaaagaggcattgatgcgtgaaacttttggcaagcggtttacgctgattatcgagcctggtttctctcccgatcaggctgaactttcctcaacacgatatgccgttgagttttcactttctcgtcatttcaacgcgttactgaaatggttacgtaatggtgaagataaaagaggtagcgatgaatattaaaattaatgagataaaaatgacgccccctacagcatttacccctggcctggttatagaggaacaagaggttatttcgccttcaatgttagctctccatgagttacaggaaacggcgggggcagcgctctatgagacgatggaagaaataggaatggcgctgagtggtaaactgcgcgaaagtaataaattcactgatgctgagaaactggagcgcaggcagcaggctttgctgcgtttgataaaacaaatacaggaggataatggggcagcgttgcgtccgcttaccgaagagaatagtgatcctgatttacagaatgcgtatcaaattatcgctcttgcaatggcgcttactgccggcgggttgtcaaaaaagaaaaaacgcgatttgcaatcgcaactggatacgcttacagcggaggagggatgggaacttgccgtttttagtttactggaacttggcgaagtggataccgctacgctgtcctcgctgaagcgttttatgcaacaggcgatagacaacgatgaaatgcccttatcgcagtggttcagacgcgtggcagactggccggatcgcggtgaacgggtccgtattttgctaagagcaatagcctttgaacttagcatatgcatcgaaccctcggagcaaagtcgtttggccgcagcattagtacgcttgcgtcgtttgttgttattccttggccttgaaaaagagtgccagcgtgaggagtggatttgccagttgccgcctaatacattactgccgctactactcgatatcatttgtgagcgctggcttttcagcgattggttgcttgatagacttaccgctatagtttcttcatcgaagatgttcaatcggttactccaacaacttgatgcgcagtttatgctgatacccgataactgttttaacgacgaagatcaacgtgaacaaattctcgaaacgcttcgtgaagtaaagataaatcaggttttattctgatacctggctttcaatatttaggtaaattggctttctggctcatcatgaggcgtcaggatggattgggatctcattactgaacgtaatattcagctttttattcaattagcaggattagctgaacggcctttagcaaccaatatgttctggcggcaaggacaatatgaaacctgtctaaactatcataatggtcgtattcacttatgtcagatactcaagcaaaccttcttagacgaagaactgctttttaaagcgttggctaactggaaacccgcagcgttccagggtattcctcaacgattatttttgttgcgcgatgggcttgcaatgagttgttctccacctctttccagctccgccgagctctggttacgattacatcatcgacaaataaaatttctggagtcgcaatgcgttcatggttaggtgagggaatcagggcgcaacagtggctcagtgtatgcgcgggtcgtcaggatatggttctggcgacggtgttattaatcgctatcgtgatgatgctgttacctttgccgacctggatggttgatatcctgattactatcaaccttatgttttcagtgatcctgcttttaattgttatttatcttagtgaccctctcgatttatcggtatttccgtctttattacttattactacattatatcgtttgtcactcacaatcagcacatcacggctggtactgttacaacataatgccggtaatattgtggatgctttcggtaagtttgtcgtaggaggaaatctcaccgttgggttggtcgtatttaccatcattactattgtgcaatttattgtcattacaaaaggtatcgagagggtggcggaagttagcgcacgtttctcgcttgatgggatgccaggcaaacaaatgagtatcgatggcgatttgcgtgccggagttatcgatgcagaccatgcccgtacattaagacagcacgtccagcaggaaagccgttttctcggtgcgatggacggtgcaatgaaatttgttaaaggcgatacgattgccggtattattgttgttctggtgaacattatcggcggtattattatcgctatcgtacaatatgatatgtcgatgagtgaggctgttcacacttatagcgtactgtcaatcggagatggtttatgtgggcaaattccatcgctgctgatttcccttagcgcgggaattattgtcacccgtgttccgggtgagaaacgccagaacctggcgacagagttgagttctcaaattgccagacaacctcagtcgctcatattaaccgctgtggttttaatgctcctcgctttaattcctggctttccttttatcactctcgctttcttttcagcgttgttagcattgccaattatcctcattcgccgcaaaaagtctgtggtttccgcaaatggcatcgaagcgccggaaaaagatagtatggttcccggcgcatgtcctctaatcttacgtcttaccccgacgttacattctgccgacctgattcgtgatattgatgccatgagatggtttttatttgaggataccggcgtccctctccctgaggtgaatattgaggttttgcctgaacccaccgaaaaattgacggtactgctatatcaggaacccgtgtttagtttatctattcccgcccaggcggattatttattgataggcgcggacgctagtgtggtgggtgacagccagacgttaccgaacggaatggggcagatctgttggctttcaaaagacatggctcataaggcgcaaggttttggactggacgttttcgcgggcagccaacgtatctctgccttattaaaatgtgtcctgcttcggcatatgggagagtttattggtgttcaggaaacgcgttatctaatgaatgcgatggaaaaaaactactctgaactggtgaaagaacttcagcgccagttacccattaataaaatcgctgaaactttgcaacggcttgtatcagagcgggtttctattagagatttacgtcttatttttggcacattaattgactgggcgccacgcgaaaaagatgtcctgatgttgacagaatatgtccgtatcgcgcttcgccgtcatattctgcgtcgtcttaatccggaaggaaaaccgctgccgattttgcggatcggcgaaggtattgaaaacctcgtgcgtgaatccattcgccagacggcaatggggacctatactgcgctgtcgtctcgtcataagacgcagatcctgcaacttattgagcaggcgctgaagcagtcagccaaattattcattgtcacttctgtcgacacccgccgtttcttgcgaaaaattacagaagccaccttgttcgacgtaccgattttgtcatggcaggaattaggagaggagagccttatacaagtggtagaaagtattgaccttagcgaagaggagttggcggacaatgaagaatgaattgatgcaacgtctgaggctgaaatatccgccccccgatggttattgtcgatggggccgaattcaagatgtcagcgcaacgttgttaaatgcgtggttgcctggggtatttatgggagagttgtgctgtataaagcctggagaagaacttgctgaagtcgtggggattaatggcagcaaagctttgctatctccttttacgagtactatcgggcttcactgcgggcagcaagtgatggccttaaggcgacgccatcaggttcccgtgggcgaagcgttattagggcgagtcattgatggttttggtcgtccccttgatggctgcgaactgcccgacgtctgctggaaagactatgatgcaatgcctcctcccgcaatggttcgacagcctatcactcaaccattaatgacggggattcgcgctattgatagcgttgcgacctgtggtgaagggcaacgagtgggtattttttctgctcctggcgtggggaaaagcacgcttctggcgatgctgtgtaatgcgccagacgcagactgcaatgttctggtgttaattggtgaacgtggacgagaagtccgcgagttcatcgattttacactgtctgaagagacccgaaaacgttgtgtcattgttgtcgcaacctctgacagacccgccttagagcgcgtgagggcgctgtttgtggccaccacgatagcagaattttttcgcgataatggaaaacgagtcgtcttgcttgccgactcactgacgcgttatgccagggccgcacgggaaatcgctctggccgccggagagaccgcagtttctggagaatatccgccaggcgtatttagtgcattgccacgacttttagaacgtacaggaatgggggaaaaaggcagtattaccgcattttatacggtcctggtggaaggcgatgatatgaatgagccgttggcggatgaagtccgttcactgcttgacggacatattgtgctatcccggcggcttgcagagagggggcattatcctgccattgacgtgttggcaacgctcagccgcgtttttccagtcgttaccagccatgagcatcgtcaactggcggctatattgcgacggcgcctggcgctttaccaggaggttgaactgttaatacgcattggggaataccagcgaggagttgatactgataccgataaagccattgatacctatccggatatttgcacatttttgcgacaaagtaaggatgaagtatgcggacccgagctactcatagaaaaattacatcaaatactcaccgagtgatcatggaaactttgctggagataatcgcgcggcgtgaaaagcaattacgcagcaaacttaccgtgcttgatcagcagcaacaggcgattattactgaacagcagatttgccagacgcgcgctttagcagtgactaccagactgaaagaattaatgggctggcaaggtacgttatcttgtcatttattgttggataagaaacaacaaatggccggactattcactcaggcgcagagctttttgacgcaacggcagcagttagagaatcagtatcagcagcttgtctccaggcgaagcgaattacagaagaattttaatgcgcttatgaaaaagaaagaaaaaattactatggtattaagcgatgcgtattaccaaagttgagggaagtcttgggttgccatgccagtcttatcaggatgataacgaggcggaggcggaacgtatggactttgaacaactcatgcaccaggcattacccattggtgagaataatcctcctgcagcattgaataagaacgtggttttcacgcaacgttatcgtgttagtggcggttatcttgacggtgtagagtgtgaagtctgtgagtcaggagggctaatccagttaagaatcaatgtccctcatcatgaaatttaccgttcgatgaaagcgctaaagcagtggctggagtctcagttgctgcatatggggtatataatttccctggagatattctatgttaagaatagcgaatgaagagcgtccgtgggtggagatacttccaacacaaggcgctaccattggtgagctgacattgagtatgcaacaatatccagtacagcaagggacattatttaccataaattatcataatgagctgggtagggtgtggattgcagaacaatgctggcagcgctggtgtgaagggctaattggcaccgctaatcgatcggctattgagcctgaattgctatatggaatagctgaatgggggctggcgccgttattgcaagccagtgatgcaaccctctgtcagaacgagccgccaacatcctgcagtaatctaccacatcagctagcgttgcatattaaatggacagttgaagaacatgagttccatagcattatttttacatggccaacgggttttttgcgcaatatagtcggagagctttctgctgagcgtcaacagatttatcctgctcctcctgtggtagtccctgtatatttaggctggtgtcagcttacattaattgaacttgagtctatcgaaatcggcatgggcgttcggattcattgctttggcgacatcagactcggtttttttgctattcaactacctgggggtatttacgcgagggtgttgctgacagaggataacacgatgaaatttgacgaattagtccaggatatcgaaacgctacttgcgtcagggagcccgatgttaaagagtgatggaacgtcttcagtcgaacttgagcagataccacaacaggtgctctttgagattggacgtgcgagtctggaaattggacaattacgacaacttaaaacgggggacgttttgcctgtaggcggatgttttgcgccagaagtgacgataagagtaaatgaccgtattattgggcaaggtgagttgattgcctgtgggaatgaattcatggtacgtattacacgttggtatctttgcaaaaatacagcgtaaacctgataagaaaaataatatgcgaacaatataatagcgttccaggtcgtgtcatgagagatacagtatgtctttacccgattcgcctttgcaactgattggtatattgtttctgctttcaatactgcctctcattatcgtcatgggaacctctttccttaaactggcggtggtattttcgattttacgaaatgctctgggtattcaacaagttcctccaaatatcgcactgtatggcttcgcgcttgtactttccttattcattatggggccgacgctattagctgtaaaagagcgctggcatccggttcaggtcgctggcgctcctttctggacgtctgagtgggacagtaaagcattagcgccttatcgacagtttttgcaaaaaaactctgaagagaaggaagccaattattttcggaatttgataaaacgaacctggcctgaagacataaaaagaaagataaaacctgattctttgctcatattaattccggcatttacggtgagtcagttaacgcaggcatttcggattggattacttatttatcttccctttctggctattgacctgcttatttcaaatatactgctggctatggggatgatgatggtatcgccaatgaccatttcattaccgtttaagctgctaatatttttactggcaggcggttgggatctgacactggcgcaattggtacagagcttttcatgaatgattctgaattgacgcaatttataacgcaacttttatggatcgtcctttttacgtctatgccggtggtgttggtggcatcggtagttggtgtcatcgtaagtcttgtccaggccttgactcaaattcaggaccaaacgctacagttcatgattaaattattagcaattgcaataactttgatggtcagctacccatggcttagcggaatcctgttgaattatacccggcagataatgttacgaattggagagcatggttgaatgacacaacaggtaaatgagtggcttattgcattggctgtggcttttattcgaccattgagcctttctttattacttcctctattaaaaagtggcagtttaggggccgcgcttttacgtaatggcgtgcttatgtcacttacctttcccatattaccaatcatttaccagcagaagattatgatgcatattggtaaagattacagctggttagggttagtcaccggagaggtgattattggttttttaattgggttttgtgcggcggttcccttttgggccgttgatatggcggggtttctgcttgatactttacgtggcgcgacaatgggtacgatattcaattctacaatggaagctgaaacctcactttttggcttgcttttcagccagtttttgtgtgttattttctttataagcggcggcatggagtttatattaaacattctgtatgagtcataccaatatttaccgccagggcgtactttattatttgatcggcaatttttaaaatatatccaggcagagtggagaacgctttatcaattatgcatcagcttctctcttcctgccataatatgtatggtattagccgatctggctttaggtcttttaaatcggtcggcacaacaattgaatgtgtttttcttctcaatgccgctcaaaagtatattagttctactaacgctcctgatctcattcccttatgctcttcatcactatttggttgaaagcgataagttttatatttatctaaaagactggtttccatctgtatgagcgagaaaacagaacagcctacagaaaagaaattacgtgatggccgtaaggaagggcaggttgtcaaaagtattgaaataacatcattatttcagctgattgcgctttatttgtattttcatttctttactgaaaagatgattttgatactgattgagtcaataacgttcacattacaattagtaaataaaccattttcttatgcactaacgcaattgagtcatgctttaatagagtcactgacttctgcactgctgtttctgggcgctggggtaatagttgctactgtgggtagcgtgtttcttcaggtgggggtggttattgccagcaaggccattggttttaaaagcgagcatataaatccggtaagtaattttaagcagatattctctttacatagcgtagtagaattatgtaaatccagcctaaaagttatcatgttatctcttatctttgcctttttcttttattattatgccagtacttttcgggcgctaccgtactgtgggttagcctgtggcgtgcttgtggtttcttctttaataaaatggttatgggtaggggtgatggctttttatatcgtcgttggcatactggactattcttttcaatattataagattagaaaagatctaaaaatgagtaaagatgacgtaaaacaggagcataaagatctggagggcgatcctcaaatgaagacacggcgtcgggaaatgcagagtgaaatacaaagtgggagtttagctcaatctgttaaacaatctgttgcggtagtgcgtaatccaacgcatattgcggtttgtcttggctatcatcccaccgatatgccaataccacgcgtcctggaaaaaggcagtgatgctcaagctaactatattgttaacatcgctgaacgcaactgcatccccgttgttgaaaatgttgagctggcccgctcattattttttgaagtggaacgcggagataaaattcctgaaacgttatttgaacccgttgcagccttgttacgtatggtgatgaagatagattatgcgcattctaccgaaacaccataaatgcttttggtatgcttcttcaggccactgcgaaggttaagagggtaatagcgtatagagcagtgcttgacgataaaggtgagagactgaaaataatcgcttttagcctggcacaagcaccagatagcgtattataaaattaaacaagataatggattggtgcgtctgaatggactcgaaccatcgacccccaccatgtcaaggtggtgctctaaccaactgagctacagacgcattaaaatgatggtgcgttcaattggactcgaaccaacgacccccaccatgtcaaggtggtgctctaaccaactgagctatgaacgcaacgttgtaggtgacaacggggacgaatattagcgtcacaaccgcaatgaggcaagagggaaatcgcaattttcttcctgaaatcacctgattgcggtggaaatatgcaacatgtcgaaaaaatagccgccatgcgacggctatcgtcgtattatcgcgcagcgcgctgcaaaatgatggcggacggctgacgttgtagatagcgcatccgtagcatcattaacaccgccgccgaggtcaggccgatgatgaaccccatccagaagcctgccggtcccatacgatccaccaccaaatccgttaacgccaggatataaccgctgggtaaacctaacacccagtaggcggtaaaggtgataaaaaagatggaacgcgtatctttataaccgcgcagaataccgctgccgataacctgtatagagtcggaaatctggtaaaccgcagcgagcagcattaattgcgcggcaagcgccacgacctcagggttgtcattgtagagcaaagcaatatgcttacgcagagtaacggtaaaaatagcggtaaccacagccatacaaatgccgacgcctaaaccggtacgcgctgcggtttgcgcatccagcgttgagccctggcccagacgataacccactcgaatcgttaccgccgcagccagcgacatcggcagtacgaacatcagcgagctaaagttaagcgcaatctgatgaccggcgacatccacaatacctaatggcgaaaccagcagcgcaacgaccgcaaacaacgtcacttcaaagaacagcgccagcgcaatcggcaaccccagttgaatcaggcgcttcatgacgacgctatcaggtttgccaaagcctttttcattacgaatatcacgcattgaacgcgcgtgtttaatgtaagaaagcatggcgataaacatcacccaatagaccgccgcagtcgcaacgccgcagccgataccgccgagttccggcataccaaaatggccatagataaaaatatagttcaccggaatattcaccagcaggcccaaaaatcccatcaccatacccggtttggttttggccagaccttcgcactggtttcgcgctacctgaaagaaaaggtatcctggcgcgccccacagcagcgcgcgaagataacccacggctttatcggccagcgccggatcaatattatgcatagagcggataatgtatccggcattccacaggacgatcatcaccagcacggagacaaagcccgccagccagaacccttgtcgaacctgatgcgcgatacgctcacgacggccggagccattgagttgcgcaatcacaggcgtcaaggccagcagtaagccgtgaccaaacaaaatggcgggaagccagatagaggtgccgatagcgacggcagccatgtccgtagcgctatagcctcccgccatgacggtatcgacgaatcccattgcggtctgtgccacttgcgcaaggatcaccggtatcgctaacgctaataactgacgcgcttcactggtatacttctgcacgtattcaccttttattttgttgttatatgaaagactaaaaagccgccgtagtggcagccaaaagaaatagcaggggaaatttcagtctattgtagcggggtattactatttctccagtgaaaaaacagttgttaacggcgcattgctggcaagctgtttttccacctgctattgtgctgaacagttctgcgtttatttatttcaggagttgaagatatgtttacggggatcgtacagggtaccgcgaaactggtatcgattgatgaaaaacccaactttcgcacccatgtggtgacgttaccggactacatgctggaggggctggagacgggggcgtcggtagcgcataacggatgctgtttgacggtaactgaaataaacggcaatcagataagctttgatctgatgaaagaaacgttgcgcatcaccaatctgggcgcgttgagggtaggtgatgaggtcaacgtagagcgcgccgccaaattcagcgatgaaatcggtggacatctgatgtcggggcatattattacgacggcggagatcgcgaaaatcctgacctctgaaaataaccatcaggtgtggtttaaagtgcaggatgcgtccctgatgaagtatatcctgtacaagggctttatcggcgtcgacggcatcagtttgaccgtcggcgaggtaacgccaacgcgcttctgcgtgcatctcattccggaaacgctggaacgtactacgcttggcagaaaaaaactgggtgagcgtgtgaatatcgagatcgatccgcaaacgcaggcggttgtcgataccgtagaacgcgtactggctacacgagaaaatgtggtcagaaatcaggccgacattggctaacggaaaataagattcccccgcatgaaatgcgggggagatgattagcgaggaacgcgcagaccgttttcaacgccgcgcgtaaataccacctgccaaagctggatatcacgcgcgcgaaacgcacccgcgcaggcgttgagataatagctgaacatacgtttaaagcgctcgttataattgcccgcaatctctggccaggcattgataaagcgctcatgccacgccatcagagtcgtgtcatagtcggcgccaaagttatgccagtcttccattacaaagtgtgattcgctggcctcggcgatttgacgaacagacggcaagcaaccgttggggaaaatatacttattgatccacggatcgacattatgatcggtttttttagaaccaatagtatggagcaggaaaagaccatccggttttaaattcctgtcaacaacttcaaaataggtgttgtagttttttggcccgacatgttcgaacatgccgacggagacgattcggtcaaactgatcgttaaggtcgcgataatcttccaggagaatggagacatccagaccttcgcaacgcgtctgcgccattttttgttgttcagcggagatcgttacgcccaccacgctaacgccataatgggtcgccatatattgcgacaggccgccccagccgcagccgatatccagcacacgcatccccggttgtagctgtagcttttcgcaaattaatttcagcttggcttgctgtgccgcttccagcgtatcggcatctttccagtaggcgcaagaatattgcatatagggatcgagcatacgggaaaaaaggtcattaccaagatcgtaatgttccttgccgacaatccaggcgcgttttttactttgtagattaatcagacgcgcgccgaggatacggagcgtatctttgacatggtgggggagttgattttcaagaccggcacgtaagactttgctgaagaaaatatccagacgctcgcattcccaccagccatccatgtaactctcacctaaccccaacgatccttcctggaggacgcgtttaaaaaaatcgggattcttaacacgaatgtcagacggggcggaaccattaattgtaatatccgcacgacttaacaattcgttggcgattcggtaccagttatcatccggtacgctgacttcttctatacacgatgaactcatagtttctccatcactggacggtgatcagaaccttaaaacagcgtagacgcttttttggctttgtgagaaatcccacggacaattccgtgagccagttatccgacgtagaacagaggaagggaggagcccttgccgaaaaggccatccatggtgaatcgggaacactccggttcccgttaatgcctaataattatcgtaatataacaaccgggaatcagtataggccgcaatttttgatgattcaaccgaaaattgttagcgtgctaattaccagcggttaacaagtctttagtgagacttgtcgtgggcgacattggcatggggaaatccagtctcagcgcaatctgcatgagactgcattttgtaacctaacgccgccagaacaacggtagagagcattacgctggtggtggtcagcagcggcgtgctgatgagccatgaaaccaccaggcttgccaggaaacataaccccagttgcagcgtattttgtagcgccgcagcgcgccccgtggcttgagggaaagggcgtaacgcttgcgcgacgacgatagggtagattgcgccattagcaatcgccattacgcagaaaggaatcaggatctccaccagtgaggcattattcagaaggcccgctccccaggtggcgataacgctcagcgcatacagccctaacagccacggaagcaattggtagccctgccatttttgtagcgccgcgcggcaaccatatccgccaatcagaaaagcgatggtttgaggaacatagctcaggccaatcactgccgggctgtaacccatcgcgctgagaataaacggggaccctgttagccacgcaaaaaagctggcggaacaggcggcataaatcagcacattaccgcgataggttttagagcgtaacaacgtcgcgaaagtgagtttatcctgtccttcggtacgcgcttttaccgatggttttaagcgcagcgccggcaacatcagcaacaacgtaatcacgaacagggtggcgaaaatcacctgccatgagaaatgcgtcagtatccagcttcccagtaagggcgcaagcgccggggataatcccaccagtggcatgatcgtggcgaagatacggttaattttttgcgaaggataataatcggtcaccagcgcttgccagattaccgttgccgcacaaacgccgacggcctgcacaaagcgcagcgtcagcagtgctgccgcgctttctacccacagcatccccagacttccgagtgcaaagatagataaccccagcagtaaaatcggtttacggccataacgatccgatagcggtccccaaagtagttgcgcgacggcaaagccagctaaaaacaggcttaggctggcgctgacagcggcggcaggcgtttgtaaatccgcctgtatggcggcaaacgcgggcaggtacatgtccgtagccagaaatcccagcacgctaaggccggctaaccagactaaaaaaccttttccaggttgcatatttgtttctctttcttatcagacagacattgtcgcagagtgtagggagtgaaattacggttgtgaaacgttaatatttgtccagtgaattcaaaatttttgtaggcaaattatgtggtcggaatactcgcttgaagtggttgacgccgtggcgcgcaatggcagttttagcgcggcggcgcaagaactgcaccgtgtgccttcagcagtcagttacaccgttcgtcagttagaggagtggctggccgtaccgctttttgtacgacgtcaccgtgatgttgaactaacgcctgctggcgtctggtttttaaaagaagggcgttctgttatcaaaaaaatgcagatcactcgccaacagtgtcagcaaattgctaatggctggcgcgggcagttagctattgcggtggacaatatcgtcagaccagaacgtacccggcagatgatcgtcgatttttatcgtcattttgacgatgtggaactgctggtttttcaggaggtgtttaacggcgtctgggacgcgctctccgacgggcgtgtcgaactggcgattggggcgacgcaggcgattccggtaggggggcgttacgcttttcgggatatggggaccctgagctggagctgcgtagtggcaagcgatcacccgctggcgtcgatgcctgggccgttaagcgatgataccctgcgcaactggccgtcgctggtcagggaagacacttcgcgaaccttaccgaaacggattacctggttgctggataaccaaaaaagggtcgtcgtaccggactgggagtcatcggcaacctgcctgtcggcaggactatgcgtgggaatggtgccgacgcattttgcccgacagtggatagacagcggaaaatgggtggcgctgacgttagagaatccgtttcccgatgcggcctgttgcgtgacgtggcagcaaaacgaggcctcgcccgcgctggcatggctgctggactatttgggcgatagcgaaacgttgaatcgggagtggctgcgggagccagaagaggctcccgacagcggggattaacgccgatagtcgcggaacgggccgtcagcgaccgagcgacgctcaaccaggcgtggatgaacttcaatagactgtgactcttcacgcttattgacgatgcgatccaatagcatattaaatgcggtttcgcctaaagagtctttgggctggtgaatcgtcgtcagcgccggggtaaagaaacgggcgttacgcacattgtcataaccgatcaccgaaacgtcctgcggtacgcgaagccccatttcgtcagctgcgcaaagcgcgcccatcgccataatatcgccgccgcagaaaacggcggtagggcgatgtgactgcgataagatttgctgcatcgcgtggtaaccggattccggctcgaagtcgccctgaacaatccagttgtccggcacgttgatcagcgcctcctccatggctttcataaagcctgccagccgccccgcgcctgtgttgcgctccagcgggccgggaataacgccgatatcccggtggccgcgctcaaccagataacgacccgccatatagccgcctgcaaaggcgttatcaatcaccgtgtcggtaaaatcggccttcgcctcaccccagtccatcaccaccatcggaatatggcgatactcttccagcatggaaagcagaggttctggatactcagaacacatcaccagcaggccatccacgcgcttttgcgccatcatggacaggtaggcgcgctgtttttccaggttattccaggcgttgcctaaaatcagcgtatagcctttctggaaacagtttttttcaactgcctcgataatttcggcaaaataggccgcttcgctgctggtcgccagtaagcctatcgacttggtatggttaaccttcaggctacgcgcgacggcgctgggagagtagtgcagctctttaattgccgcccagaccgcgttacgcgtttcttcagcgacaaaacgcgttttgttgattacgtgtgatacagttgtagtggaaacgtttgcccgtttcgctacatctttaattgttgccattacatttcactccagaccctcgctaagctcctgagaaacgccaggtaaacgtttgcctacacacaccctaatcgcaacatcagggttgcggcacgccggaaaaacgacacggaacgtcaggaaggggtcaatggccgttacgctaattcagtaagcctggaattttgtctgatcttgaggaaaaggggaagcgttaaaaacagttatcaatataaaacatgagagatttttgtgcgggaatgtgcaaaaatgcgctatatcactttttgtgtgggaataaaaaggagaaaacttgatgagtaccgacctgaaattttcgttgattactacgctgattgttctgggcgtgattgtcgcaggtggattaacggccgctctgcactgatttcctctcttctgagagtgggcgtctcctctattctatccctctctaaaacgcagaaggcgtaccttctgcgtactcagacttatgcggcgagatttttcgcaacaaattcccagttaaccagcgcccagaaatgctccagatagtttggacgggcgttgcggtagtcgatgtaatacgcgtgttcccacacatcaaccgtcagcaacggcgttgcatccgtagtcagcggcgtaccggcatttgaggtagaaacgatagccagtttgccatcagcgctttttaccagccatgtccatccggaaccaaagtttttgatagcggcatcggtgaactgcgctttaaattccgcgaagctgccaaaagatgccgcgatagcatcagccagtttcccggtcggttcgccgccagcgtttggcgccaggcagttccagtagaaggtgtggttccacacctgagcggcgttattaaagatgccgccttcggaagtgcgcacgatctcttccagcgatttgccttcaaacgccgtgcctttgatcaaattgttaagattggtcacgtaagtctgatgatgtttgccatagtgatattccagcgtctcagcagaaatatgcggcgccagagcatctttggcatacggtaatgcaggtaattcgaacgacattgcttctctccttattattaatattgcgcacgcacaataaccctggtgcgcgtaaggatagggtagcaaattgagaggtggcgcaaaagaagaagttatcctgtcgttaaacgacaggataaaatattagcgaattgttttaggcgtcatcacccggcgggcgccgacataatgacgctgccagtactcttcgttcagtgaggtgatcttaatttcctgaccgctgcgcggagactggataaacttaccgttgccgacatagacgccaacgtgatcagcggtgccgcgcccctgtgtacggaagaacaccagatcgccgtttttcaactcgctacgctcaatgggggccgcgtcacgcaggtgatacatctcattcgccgttcgggggatacggatcttcactaaatctttataggcataataaaccagaccgctgcaatcaaaaccggtgcgcggcgatgcgcctccccagtgatacggtttaccaatctgattcatgagcttggacatcgcggttttcgtcgccttttgtacttttgcacgatgcgcatcggcaatagagaccggcaatgttcctttccccttcacgcagtgcggcttacggcctttacgcgtcgtgcatttttccgttacgtcgagggcggcgattgacgtgggcgcggttctgttacgacgatgcgtcgtatgacgagattttgtggcggcggtggtacgttttggcgtagaagcggaagaagaacggctggtttttgaggttttttttacgttttttttgctggttttactgatctttttagttgtgcttttctttttatctgccgttttcgtgacatgagaaacagcaggcgtcgctttggcttgcctggaagcatgggccattggcgtaaaggggagagtagtaaaaagtaaagcacagagcgtgatcgagattttgtttatccgcgccactgagcaatcctctgttaaaggcaggcgattcatgcctgcgtatgatttacaaaacctgataattctaatctacaaaagcacagattggtaattgcttttggtttctgaagctatgtttcgttaacagatgtaaaaaaatagcaattaatgctaaacacgaacgcgttatctacaaatcactgcgcggcaacccgcttaaaagatattttgtatacaacttattcccgcagacggtaaaataataaggcatgatgaaaatgttattttccgttgccagcctgacccgttacaatgacaggcttcggtcgtaaaagtagtttaaggaagcgagacaatgagcaccactatcgaaaaaattcagcgccagatcgctgaaaacccgattctcctgtatatgaaaggttcaccgaaactgccaagctgtggtttctctgcgcaagccgttcaggcgctttcagcctgcggggaacgttttgcctatgttgatatcctgcaaaacccggatattcgcgctgaattaccgaaatacgccaactggccgacattcccacaactgtgggtggacggcgagctggtcggcgggtgtgatattgtgattgaaatgtatcagcgtggcgagctgcagcagcttattaaagaaactgcggcaaaatataaaactcaggagccggacgcagagtaatctgtgaaaggggaaagcgacctgtaaaggtcgcttttttaccgccatcgtgagcaagagcggcgttgttagcctcgttatttgtccgtcggcaaaggtaacggccagccgcccaggcgcttccagcgattgacgatttcacaaaacagcaccgctgtccgctcggtatcatacaaagcggaatgggctttttcaccgtcaaactccatacctgccgccaggcacgcttttgataacaccgtttgtcccagcgccagtccgctcaatgccgcagtatcaaaggtgacgaacggatgaaacgggttacgtttcagcgaggcgcgctctgcggcggccatcataaaactgtgatcaaaagtggcgttatgcgcgaccataatggcgcggctacaaccgctgtctttgatacctttacgtaccattttgaaaatagcgtgtagcgcctcatattcactcaccgcgccgcgtagcgggttagagggatcgataccgttaaacgcaagcgcttccggctgtaagttggctccagcgaacggctctacatggaaatgcagcgtcatgtccggcatcaaccagccttgttcatccattttcagcgtgatggcggcgatttcgagcagcgcatcggttttagcgttaaatcctgcagtttcaacgtcgatgacgacaggataaaaaccacgaaaacggtcgcacagaccggaaagttgagcgttatcggacatctgagtctcttaatacgaaaaaatgcagcgcgtattatggcaaattttacgccgggatgcagtaaaacaacgggcgcagtgacctgcgcccggcgggggatcagttacccagaccgcggcctgcgtctttagcttcaatcaattcgattttatagccatccggatcttcaacgaaggcgatgatggtcgaaccgccttttaccggccccgcttcacgggtcacgttgccgccgttctgacgaatgcgttcacaggcttcagcagcattgtcaacgctcagcgcgatgtgcccatacgcattgcccatgtcgtagctctcaacgccccagttataggttagttcgatgaccgcttcttccgtttccggaccatatcccacaaaggccagcgagtatttgtattccggattctcactggtacgcagcaatttcatgcccagaacgttagtgtaaaaagcgatggaacgctgcaaatcgccgacgcgcagcatagtatgcaataaacgcattttcgttgtccttaaaatagtcaagatattcaaagtatagcggcgatgtgaggccgctatcaatgaaattacagagtagggtagtcagtgtagccttccgcgccgccgccataaaaactttcgggacgctgtggattaagttccgctttacgttgcagacgcgccaccagatccgggttagcgatgtaatcgcgaccaaacgccacggcgtcaatcagccctttttcgatcagatcttccgctttttctggcgtataggcgccagcgccgatgatgggaccgtggaaacgcgcgcgcactttttcacggaacgcgtcgctgtacggttcgccgcccgcccagtctggttcagacatatgcagataagcgatgccgcgtttgcctaacgcttcaatcagataaagggcgtcagcttcttcattcgggccgttatcgacattctggaaagtgccgacaggagaaaggcggatgccgatacggtccgcgccccattccttaatgccggcatcaaccacctccagcaccagacgggcgcgattctctacgctgccgccgtaccgatcggtacggtgattagaagacggtgagaggaactggtgcagcagataaccgtgcgcggagtgcagctccaccagatcgaagcctgcctctcgggcattggcgatagcctggcggaaatcgttgacgatcccggggatctcatgagtatccagcgcgcgcggcgtggaagtttctacgcggatggcctggccgttttcgtcacgcaaagaggtgcgggttcccgcattgatagcggatggcgcgacgggcgcttgtccgcctggttgcaggctggcgtgtgaaatacggcccgtatgccacagttgcaccgccatatggccgccctgggcatggactccctgagtgatttttttccaggcggcgatctgctcatcgctgtgtaatcccggtgcgccggcatagcctttcgcctgcgcggagatttgtgtggcttcgctgatgatcaatccggcgctggcgcgttgacggtaatattccgccattaacggcgtaggaatgtcgcccggttcaatactccgcaaacgcgtcaaaggcgccataaatacgcgatttgtcgccgtgatggcacccaccttgaggggggtaaacagttttgctgatgacatagtggctcctgatataagtagaccggtcgtcttgtaataaaggaaataaaaacgcccgttactgctcaggcgttgcaatgatggtcttaacatgcgccaacgcattttccagcggcgcggcgctacgggatattttggcctgcaaattggcgcccagccacagggcataaagtacctgcgcctgtggcaacggctggccggtgaaatgtaaacagtggctattacggccatcttccagcgcgcgtgcaagcagtgccatgatctcctgcgcccctttatccatcgtagagcgcatatcctccgacagatcgcagacttccgctgacagtttcaccgtcaggcaaccgctgatggcgccttgctggcaaaactgctttaacgtttcctgataccaggcgagaagacgatcgcgatgattaccgggaccggaggtgaagtgcgccgtaagacgctgatgatagcaggcgtaatgtcgctcaagcatggcgacgccgaaggcttctttcgagcgaaagtagtgataaaacgaccctttaggtacctgggcggttttgagcaactcgctaagccccatgccggtaaaaccccgttgcatacaaagctgctcgccggtggccagcagatgttcgcgggtatcatgttcggtttgcttattcatgacaggcagtatagtagaccagtcggtctactgcaagcagagttgccataatgtcagttagcgtcttcaatagtcataagcgccaaacgttgaggaggggatgtggccgagcagttggagttttttcctgtagcaagcccatgtcgcggtatctgccagtctgatgagcgtggcttttgtcggggatgtatgcgcagccgcgacgaacggtttaactggcaaaaaatgagcgatgccgagaaacaaaatgtactgcggctttgtcgccagcgtttcttgcgtaaaatacgcgcaaataagcctctcccatcggaagatcctcaacaaccttcactcttttaaacgcggaattgcgtatactcaacctcattattctctatgaggaatctgttatggttcagcgtgtcaccatcgctccacaaggcccggaattttcgcgttttgtcatgggttactggcgtttgatggactggaatatgtccgcgcgtcagttagtgagttttatcgaagaacatctggatttgggcgtcactaccgttgaccatgcggacatttatggcggttatcagtgcgaagcggcgtttggcgaggcgctaacgctggcgccgcatttgcgggaaaaactgcaaatcgttaccaaatgtggtattgcgaccaccgccagagcggaaaataggctcggtcattatattaccgatcgccgccatattattctgagcgccgaacagtcattaaaagatctggcgacagattatctggatatgttgttaattcaccgtcccgatccgttaatggatgcggatgacgtcgccgaggcgtttcaacatctacatcaaagcggcaaagtgcgccattttggcgtttctaattttacgccagcgcaatttacgttgctgcaatcgcgcctgccgttcaccctggcgaccaaccaggtggagatctcgccggttcaccagcctttgttgctggacggcacattagatcaattacagcaactgcgtattcgtccgatggcctggtcatgtcttggcggcggtcgtctgtttaatgatgaggcttatcagccgttgcgccaggaactttccgttatcgcgcaagaactcaacgctagttctattgaacaggtggtctatgcctggattttacgtttgccgtcgcagccgctgccgattattggctcgggtaaaatcgaacgcgtacgcgccgcactagaagcggaaacgctgtcattgtcgcgtcaacagtggttccgaatccgcaaggcggcactgggttatgacgtgccgtaatcgccaactcgttgactttccgttcatgttttcgccagtggtttacacttaacaggcgaccacatgtaacggaggttttatgaagcgattaagtttagcgatggtgacgctgctggcctgtgcgggtgcgcaggctgccagcgagaaagtagagatgaatctggtgacggcgcaaggcgtaggacagtctatcggcaccgtcgtcatcgatgaaaccgaaggcggcttaaaatttaccccacaccttaaagcgttgccgccgggcgagcatggttttcacattcatgccaaaggtagctgccagcccgcgattaaagacggcaaagcggttgccgcagaagccgctggtggtcatctggacccacaaaataccggtaagcatgaaggaccggaaggtcaggggcatctgggcgacctcccggtgttagtcgttaataatgatggtatcgccaccgaaccggttactgcgccgcgtctgaagtctcttgatgaagtgaaagataaagcgctcatgatccatgtgggcggcgataacatgtccgatcagccgaaaccgctcggcggcggcggaacgcgttacgcctgcggcgtcattaaataacccggagacagtgttccctgcgctggagcctgttccagctgcgacagcgaacagtgtaaacgccagataatcgccgccagctcatgcgcggcgggttgatgatgatgtgcgagcgtgtcgcagatacgctgtagttcctgtagcgtgacggcaagcgggcgttgctgcacgtcgcgctcgctcatcacatcgcgcagcagggatatacaaatatcccgcacccgggaaagcggatcggaacgcgactcccaggcgcgcagctgccacaccacatgcgagcagttcagcagcaccactccccaacgtaataaccaccggcgcgccagcgcatcctgactattgctgagctgactgacgtgatgataggtcagcgattcaaactcgctttcgctatgggaagggtgacggctaagctgatcgacgaaatcccggcgtagcgcgcggatatggcggcggctttttacggcatcggaaccggggcgcaaaatcgcaaacgccagccaggaaatcgcgacgccgacgatcttggcggtattatcgttaaggaagtcggcgaagtcgtacaccggtggattggtcacggcgatgaatgagcccataaaaacgataagctgcccccacagtcccgccagcttaggcatctgcagtttaagcagttgcatcgtgacgaacagcggaaaaaggaaaagcaagaattgccacagatcggtgatttgcaccatcaggccaaatttcaccacgaagctgaataaggacagcagcactaaagtacgcatcaataaggaaagcgacttaaacggcgtggcgacgatggagtagaggacgcaactgatcgccgccagggttaatgcgccgggcccggattcccattgcacgccaatactccaggcgccaatcaccgtgagcgtgcaaaaggtacgcacgccgctccagatggcctctgcgttatccgtatgccgcgcaaggccgggagtgcggcggatatggatttgatccaccggcgcgccgctttcgatcagatataattgacggctgctgcgcagatatagctggcaaaaatagcgtaatcgctgccagaacgcgaggtgacgataatcctgttcatcctgcgggcatagcggcgcaataatccgcgccacggtgtagctgtccgcgcgcggttttgccaactcagctaagagttgttcaatgacttcgcggctgttttccggcggcgtcggccagtttaaaagcattctacgcagactggagatcacgctggttagccgtaattgctggtgtaacaatgcatttagcaatgcattctgacggcgaaaacggtagtgactccagaaggcctgaatacgcagcaggttcatggtcaggatttgcccaatgaccccctcatgcgcggagcggatagcgtcggtagtctccggctgccacagtagactggcatgttccagcaagcgcgcatgcatgtttttcaacgcggtgagcagggcagtgccatccgatgtgctgggtaggatcatcatcatcatgccgccacagaggatgccgacgataacttcacatacacgtgcctgggcgatatcccacaactgcgtgatttctacaatattaaccatcgggaacgcgatgatcgccgccgtgtagccggacaactggaaagcataagcggcattattggtaaaatgcgcgcaggcccaggtacaaaaaccgatccaggcggccatgctaaataagaacaaccagggttcattcagcgtatggccggcaataatcaacgcggcggtcgcgccgagtaaactcccggcaatacgccccagacttttactgattacgccgcctacggtcggaaagctcaccactgcggccgaagtcatcgcccagtagggctcatccagattgagataataagcgaatgtcagcgcgagacacatggcaatggtattgcgcaacgcgtaacgccactggccggaggtcgctttaaaccagggcgtatttcgcagggccggcagggagagtttcattaccgctgtccaatggctacgctgcaggtagtgccggagacgagcgtgatatcctgcggcaaagcgtcaaattcgatacgtaccggtacgcgttgcgccagacgtacccacggtacgttgggtttgatatcgggcactaaaccggagtcactttccacgctttggtcgtaaatagcgcgcccgatactgccaacgtgaccctgtaacttaacattgccactatacagtgttattaatgcaggctcaccttcgcggatatggcgtagtttggtttcttcgaaatatcccattacataaaatgaatggctatctaccagggcgaaaagtggcttaccggtgctagcataatcaccggtacgcgtggaaaggttggtcacccagccggataccggcgcttttacttccgtctggctaagctgccactgcgcctgttttaacgttgccagtgcgacatctacgctggcctgcatcgctttaacattcagattggcgctatccagatcttcagcagagatgtagttacgcgataaatgtcgacgtcgatcggcttcattattcgcttttgccagatcggactgcgctttggccaactgtgcctgcgcgttaagttctgcaatatggaagggcgttttatcaatgacaaagagaacgtccccagcgttgacgaactgattatctttgatattgagttgggtaatgctgccagaaacctgtggcgttacgctgacctgttccgcgcggattttaccatcgcgcgtccacggtgactgcatatagtaattccataaccaccacgcggccagaacggcgacgacggcgacaatgagagtagaaaaatattttattgtttttaacgacatatttaccacacgatcagtaaaacgaggcccagacatacgcaaagcgtaaagagggagagatccattaacaggggatgccagatttcatcagagtatatccggtcacgcaggagtcggtgaataaacaaccagataacgaacccaagcgcaaaggctttgaagaatggcggaaagtaaacagatgctcccaacatgagatcttgtaagggcaatcctgtggcgttgagtatacacttcacaagcaatgttcctttgcgtcagacatcgatgctttagttttagccaaaaccgaagctacaggtgccaggtgcgcactatgtctgaaaaaatgtctattggtaagcaaatttagcaatacatttgttttgagaatacaaatactgcacactattctaaaatcagcataataacttagcaagctaattataaggaggtgaaattggaatcgccactaggttctgatctggcacggttggtgcgcatttggcgtgctctgattgaccatcgcctcaagcctctggaattgacgcagacacattgggtcacgttgcacaatattcatcaattgccgcctgaccagtcgcagattcaattggctaaagcgataggcattgagcagccatcgctggtacgcacgttggatcaacttgaagataaggggctaatttcgcggcaaacctgcgccagcgatcgtcgcgctaagcggattaaactgaccgaaaaagcggagccgctgatcgctgagatggaagaggtcattcataaaacgcgcggtgaaattttggctgggatttcttcagaggagattgagcttctgattaaacttgtcgctaaacttgaacacaacattatggaattgcactctcacgattgaggtgcaggggcatacgtgtggccatgtgaccacacgtaaagcctggtttagcgtggagagacagtaacctggctgccgttgctggccagcacgacacgctgacctgccgagaaacgcgtatttccttgtttctgcacaaccataatggtgttgccatcgtctttacgaatttccagttccacaccctgggttttattcattgcgctctggacgccctggcccgctacgccaccagccaccgcgcctgccgcggtcgccagtgaacgacccgtaccgccgccgatagtgttgccgaggaatccgcccaacaccgcgccgccgatagcgccaatcacgttagaatcatcaccgccctgaatttgaaccggacgaacgttaacgatagtaccgtacgttacattctgaacttgtttagcctcggatgcggtataaacatcacccgaaaggctatcattgttaacacacccagctaaggataaccccatcagtgaaacggccagtacacgtttaatcatttacccatctcctgttcttcacgaaacgctatttcagcatccctatagctaaattatatggcatttatgcagttaaggtcatatcttctgccgaaagaatgtaaaaatcataatcagaagttaattaactaatcttaaacgaagtgggaagcaagaaaagataggttattgatatccgtggacggcacggcaaaaaacgtgacgcgggcatcgcattgcaaaatacgttatgccgagtgttaaggcttaacccagcttaataaggaagaggtatgaaatcgggccgttttattggcgttatgtccgggaccagccttgatggtgtggatgttgtactggcggcaattgatgaaaccatggttgcgcaacaggcaagtctcacctggcccattcccgttcatctgaaaaaaggcattctcgatatttgccagggacaaccgcttacgctctcgcaactcggccagctggatacccagttaggccggctttttgcacaggcggttaatgcgctgttagcgcaacaacgtttgcagccgcgggatatcgtcgccattggttgtcatgggcaaacggtctggcatgagccgaccggcgaggccccgcatacgctgcaaattggcgataataatcacatcgtcgcccatacggggattacagtggtcggcgattttcggcggcgggatattgcgctgggcggacaaggcgcgccgctggtgcccgctttccatcacgcgctgttgggacatccgacggaaaaacgtatggtcctgaatatcggcggcatcgccaatttatctctgcttttccccggacaggcggtgcgcgggtacgacacggggccgggtaatatgttgatggatgcgtggatttggcgacaatgcgcgcagccctacgacaaagacgcggcatgggcgaaagaaggtcaggttattcttccattgctgcaaaagatgttgcgcgatccgtactttgctgcgtcggcgcccaaaagtacaggacgcgaatatttcaactatggctggttagagcgtcatcttacggctttccctggcgcagacgcgcgcgatgtacaggccacgctggcggagctgacggcggtctccatcgcccaacaggtgctgctcaatggcggctgcgagcggctgatggtctgtggcggcggaagccggaatccgttagtgatggcccgtctggcggcgctgttgcccggtatcgaggtttcgaccaccgataaggcggggatcagcggcgatgatatggaagcgctggcctttgcatggcttgcctggcgaacgctcgcgggcctgccgggaaatttaccttccgtgacgggggctacagaagccagtgttttaggcgctatttacccggctaacccaataactcagagttaactgaatttttcccggaccctatatcggtaaactagcaaggtcaggaaggggcgtttgcccttccagaagcaggagagctttcgggatatgcctatgaaaaagatcgcaataatgtttttacctgtgctgctgaccggctgtagcgtttatcaacaatttgttgaacgtatgcaaacggatacgctggaatatcagtgtgatgagaagccgcttaccgttaaagccaataacccgcgtgaagaggtcagttttgtttatgacaataagctgctgaccctgaagcaaggaatctcggcctcgggcgcgcgttataccgacgggatttatgttttctggtcgtaaggcgagagcgccacggtctataaacgagacagaattgtgcttaataactgtcagttacaaaatccgaagcgttgagattttcagtatgggggcgcacaatagcgccacccactgattatttctgatcaacgccatgtctgataacaaccaattgcagcagatcgcgcatctgcgccgtgaatacacgaaaggcggcttgcgtcgccgcgatttacccgctgaaccgttaaccttatttgagcgctggcttgggcaagcgtgtgacgccagactggccgatccaacggcaatggtcgtggcgaccgtagatgacaaggggcaaccgtaccagcgtatcgtattgctcaaacattatgatgaaaaaggcctggtcttttatactaacctgggaagccgcaaggcgcatcaaattgagcacaatccgcgtatcagtctgttatttccctggcatatgcttgaacgccaggtgatggtgacaggcaaagccgagcgtctctccacacttgaggtggtgaggtatttccacagccgtccgcgcgacagccagatcggcgcatgggtctctaaacaatccagccgcatttccgcgcgcggtatcctcgaaagcaaattcctggagctcaagcagaagtttcaacagggcgaagtgccgttacccagcttctggggtggttttcgcgtgagtatcgaacagatggagttctggcagggcggcgaacatcgtctgcacgatcgctttttataccaacgcgacgacggcgcatggaaaatcgaccgtcttgcgccctaaagatgcaaaaatcttgttttaagcactggtgcggatgaatccgccgttttatgctatgtctctttcgcgtctggcgaaaagtcgtgtaccggcaaaggtgcagtcgttttatacatggagattttgatggcaagcagtaacttgattaaacaattgcaagagcgggggctggtagcccaggtgacggacgaagacgcgttggcagagcgactggcgcaaggcccgatcgcgctctattgcggcttcgatcctaccgctgacagcttgcatttggggcatctggttccattgttatgcctgaaacgcttccagcaggcagggcacaaacctgttgcgctggtaggcggcgcgaccggtctgattggcgacccgagctttaaagccgccgagcgtaaactgaacactgaagagaccgttcaggagtgggtggcgaaaattcgtaaacaggttgccccattcctggactttgattgcggcgaaaactccgccatcgcggccaataactatgactggttcggcagcatgaatgtgctgactttcctgcgcgatatcggtaaacatttttccgttaatcagatgatcaacaaagaagcggtgaagcagcgtctgaaccgtgacgatcagggtatctctttcacggagttctcttataacctgctacaggggtacgacttcgcttgtctgaataaactgcacggcgttgccttacagattggcggttctgaccagtgggggaacatcacttccggtatcgacctgacccgtcgcctgcaccagaatcaggtatttggtttgaccgttccgctgattaccaaagctgacggcacgaaattcggtaaaaccgaaggcggcgctgtctggctggatccgaagaaaaccagtccgtacaaattctaccagttctggattaacaccgcagatgccgatgtttatcgcttcctgaaattcttcacttttatggacattgaggagatcaatgccctggaagaagaagataaaaacagcggtaaagcgccgcgcgcgcagtatgtactggccgagcaggtgacgcgcctggttcatggtgaagaggggctggtcgcggcgaaacggatcactgaatgcctgttcagcggttcactgagcgcgctgagcgaagctgactttgagcagttggcccaggacggcgtaccgatggttgaaatggaaaaaggcgccgacctgatgcaggcgctggtagacgccgaactccagccgtcacgtggtcaggcgcgtaagactatcgcctccaacgctgtcactatcaatggtgaaaaacaatccgatcctgaatacatctttaacgatgaggaccgtctgtttggccgctataccttattacgtcgcggcaaaaagaactattgtctgatttgctggaaataaggcattaagtaacagggagtgagaaatcactcccttatttttgatgttcaggtaaaaaaatgaagaatatcctcgctatccagtcccatgttgttttcggacatgcgggcaacagcgccgccgaatttcccatgcgccgtcttggcgcgaatgtttggccgctgaataccgttcagttttctaaccacacgcaatatggtaaatggaccggctgtgtcatgccgcccagccatctgactgagattgtccaggggattgcggacattggccagttagcgcactgcgacgccgtacttagcggttacctgggatctgccgagcagggagaacacattctcggtattgtgcgccaggttaaagcagcaaatccgcaggcaaaatatttctgcgatcccgtgatggggcatccggaaaagggttgtatcgtggcgcctggcgtcgcagagttccatgtgcgttatgcgctacccgccagcgatattatcgcgcctaacctgattgaactggaaattctcagcaaacatagcgtgaataatgtgaatgacgccgtgcaggtggcgcgagaactgattgctcaggggccagaaattgtactggtaaaacatctcgcccgcgccggttacagttcagaacgctttgaaatgctgctggtgacagcgcaggaagcctggcatattagccgtccgctggtggatttcggctcacgtcagccggttggcgctacagcgagctatccggcaacatgacattaattcagtccttccgctttaagcgctgccgcaacggtcggtctttttgcgacacgctgcatataactttcaatatgcgttgacccgtccatattcagttttacgccataggcccaacgcaatacggtaaacagataagcgtctgcaatggtaaaacgctggccgcaaatccactggtcgtctgaaagcgactcatccacatactgaaatttcttttccagaccggcgcgaacggcgggtttaagtgtttccggcgtgtcagggcggaacagcggggtaaagcctttatgcagttccgttgcaatatagttgagccattccagcgtatgatagcgagcaagactacttaccggcgccagaagctggcggtcgggaacgctgtcggcgaggtactgcataatggcgacgccttcagtcaacagtgtgccgtcatccagcagcagagccggaacctgtcctttagggttgactgccaggtaatcatcaccgttttccaggcgttttttcgcgagatcgacgccatcaagcgtaaagtctttgccaatttcgcgcaggataatatgggaagcaagagagcaggcacccggtttgtagaacagtttcatcggtaactcctttttgctgaggtttaaagtatggtagtgcggggacgagcaaaaaaaaagccgctaacgcacagttagcggcctgaatgttgtttcccggaaaattaaactgtagcggctttagagcctttttcagcggtatcatcgtcctgggtcatacggttcagcttaggcgctgtcagcagcatcaggacggcgataacggcggttgctatgccaatctgcataaatacgcgaccatagacttctagggacatcagtgggtcagtcacgtcgctcggcacagccatcaggttggcgacataaccgccgatgatgttagcgcctgccgttgtcaggaaccagctacccatgatgaagcccatcagacgctgcggaaccaactgtgcgaccattgccaggcccagaccggagatcatcagctcaccgatactttgcaggccgtagcttgcgatcagccagtttacggatacgatgccggcatcgttcgcaaatttggcgcccagcggcagaatcaggaacgcgccggaacacagcaccataccaatggcgaatttcatcggcatcggcagcgtatcgcccatcctgttataaatagcggccagaatcgggctgccggtaatgatccagaatgggttcagcgcctgatactgttccggttcgaacgcgataccgagaatagagtgctcgacgttacgaatggcaaagaagttcagcgacgtcggcatctggctgtacagtacgaagaagataatcgcctgcagcatcaaaataaaggcgacgatcattttacggcgagccgcgccgtgcatggaaaacgcttctttaccgaaaataatgacgatgccaagagcgattacgcccagcaccatacgcgcgatatcctggttgtgcagcagccaggtggcgaccgcaatcagaacgacaatacccacgattgtcagcagcagattacggaagttgatcggttcaaagtcgggtttggaaccgtagcttttcacccagcgctggcagaaagcaaagttaacgacggttatcagcataccgacgacgctaagcgcaaacgcggtgctccagccataacgcgccgccagccacggcgtcgccagcatagagaagaaggagccgatgttgacggacatataatacatcgtaaatgcgccgtcgagacgcggatcgtccttcgcgtaacaggtagacagcagggaagacgggttagctttaaacagaccattacccacagcgatagccgccatgcccatatagacgatgccagcgtcatgaccagaccatgcgaccagcgcataaccgatagccagcaccacggcacccagcataataacgcgtttggtgcccagaattttatcacctaaccaaccgccaatggcgaccaggccgtacaccagcgcactgaaggaagagaaaagggtgatggaatccgcttctgacatacccagttgttttaccaggtagacggccataatgccttgcaggccgtaataaccaaaacgctcccataactctatcgagaagattagatagaacgccttcggttgtttgaaagcgttcaaactgacgctttcagttggttttttgtttgcagtagacacttttacctcttttttacgccccgtattaacagggattgtctggcgcgtgatgagtcagactcatccgtccgattgttatattggaggggaaacggcaggtaatgttcactatctttcctctccagacaagagctttgtaataatctgttacatataactcttctggttgaatcgtccgatgtcagaaatgttatccagcgttaaatttcttcatttgaagaatggcagatttttacactgcaaaaaggccattagtttggataaaaggcgatatcttctgctatttaaggtgaaaagcagtgatataggccattatctgaaaaaatggcagagtaatgttttgtagtgaaaacggggcgtcagtctatccggttgtaaatgtaaccttaggtgtcattaaatttcacatgaagttatcaaagtgatcctgatcacggatagatagaaatttttgcgattaaaaaatgattaacctgacgtggagggaaaacgaaagcacattacatcagaaaaaggacagagactggaatgattgatggctaaaatagatccaggccgaaggtgggagcgcgctggtatgacgggcgcactccgaccatatcaaatatcgactttttctttgtattcgcaaaggtcttcaatgaggcaggagccgcagcggggttttcgggcgatacaggtatagcggccatgcaaaattaaccagtgatggcagtccactttgaactcattcggcaccactttcagtaacttctcttctacctgctcgacatttttacccggcgcgaactgtgttcggttgcatacacgaaatatatgcgtatcaacggcgatggtcggccagccgaaggcggtatttagcaccacgttagcggttttacgccccacgccgggaagcgcttccagcgccgcccgatcctccggcacttcgccattatgcttgtccattaaaatacggcaggtcttaatcacgttttccgctttactgttaaataagccgatggttttgatataggatttcacgccttctacgcccagttccagcatcgcggctggcgtattggcggccgggtaaagtttggcggtcgccttgttcacgctgacgtcggttgcctgcgcggaaagcaacacggcaatcagcaactcaaacggcgacgtgaaattgagttccgttgtggggtgcggattgctgtcgcgcaggcgcgtcagaatttccagcctttttgctttgttcatcagactttccctgtttcaccggccggaacagcggaaggcgcggtttcggcgcggcgtttcttcattttttcatcaataagatattttaccgccagcatgagtcccagaccgataaacgcgcctggcggcagcatcgccagcaggaaaggcgagtcggtgtgaaatatctcgacccgtaatacttttgcccagcctcccagcaggctatccgcgccatcgaaaagcgtaccattcccgaggatctcgcgcagtgagcccagcacgaacatcgcgcctgtcgcgcccatgccgatggaaaaaccgtccaacgcggaaagccacggtccttttttcgcggcaaacgcttcggcgcgaccaacaactatgcagttcgttacaatcagcggaataaaaatccctaaagactgatacagaccgaacgcatacgcattgatcagcatctgtactgcgctgaccaccgaagcaatgatcataacgtaaatcgggatacggatttctgccggcgtccagcgacgtagtgcggacaccgtaaggttggtcagcgttaataccagcgttgtggcgagacccagccccagagcgttggttgccgtagacgtcactgccagtaaagggcacaggccaagtagctgcaccagagcagagttatttttccataacccctgaacaacaatgtcttttatttcgctcatggctattctccacaggcggttaaatgggggagctgagcgggcagtgattcggcgtacagcccggcgcgtttaaccgcattcactacggcgcgcggcgttattgtcgccccggtaaattgatcaaaatcaccgccatcttttttcaccgcccagtgcgtatcattttcaccgctgatggttttaccgctaaagtgggtaatccagtcagacaaacggcgctcaattttatcacctaaccctggcgtctcatgatgttccgtcacgcgcgtccccaggatagtaccgttgaaatctgcgccaacaataagctggatagcgccggaatagccatctggcgcggtggcctcaatgatggccgctacgggtttatcatccttgcgagcgataaaaacacggtgtgtgcctttgccgagggcgggcgcatcgaccagataacagctctcttgcagattattattgtaacgatctggcggcaatacctgatcgaacagggcatgttgttgttgcagcgcttgttcgtggatggttgattttgtcatctgattaatcaccgcggtcaatcccgtagagcctgcggcaaaaagcgccagcgtaataccgtgtttacgaatcgttttcagcatggtttatcctttgcgatgtccatagacgcgggggcgcgtgtagtagtcgatcagaggaaccgtgatattcgccaacaggacagcaaaagcaacgccgtccggatagccgccgaagctacgaatcagccacactaataccccagccagcgcgccgaaaattaaacgtccacggttggtcgtggaggcggtaaccggatccgtcaagataaaaaatgcgcccagcatggtggcgcctgacagcagatgaagctgcggcgaggccagcgtagcgggcgagaaaagccaacctaacgcggcgcatagcgccagcgtgagcagaaaactgaccgggatatgccagcggatggctttttgccacagcaggaatacgccgccgacaagccaggcgaggttaacccactgccagcccacgccagccagcgcaccgctgtatatcgggtactgcatgatttgctcaacggagtgcccggcgcgcaaggacgttttaaacgtatccagcggcgtcgcctggctgataccgtcaataccgatacgtagtagcgtcatatcgccgccgctggcggtatgcccgctaaaaatcatccgtaacgtgtccagtatatcgggcgttgttgcggctatttcataaggcggcaaccagcttgtcatttgcaccggaaaggaaattaatagcaccacgtagccgatcatggccggattaaaggggttttgtcccagcccgccatataactgtttagcgataataatggcgaatccggttcccagcacgaccatccaccagggcgcgagcggagggatgctgaccgccagcaaaagccccgtcaataacgcggaataatcctgcaggtgactggcgaccgattgtttgcgcagtctaaggacaatggcttccgcgacgagcgccgtgatagcagccagaacgatctggaaaagcgttccccaaccaaaaaaccacgtctgcgcggcaatccccggcagagcggcgattaataccagcaacatgattcgcgatgtctggcgctggttatgggtataaggcgagcttgcgattctgaataccatttaatcctcgttaacaacctgctgctgtgctgctttttttgcctgaacgcgagcgatagccgcagcaaccgcggctttacgcgggtcggccggttcgacaggttcgcttacggtctgctgctcctgcttacgggctttggcacgggcgatcgccgcttccaccgcggctttacgcggatcgaccggttcggcgggttcgcttccggcctgctgctcctgtttgcgggctttggcgcgggcgatagccgcttccaccgcggctttacgcgggtcgaccggctcggcaggttcgcttccggcctgctgctcctgcttacgagctttggcgcgggcgatagccgcttccactgcggctttacgcggatcgtcgccggatatcgcgctgtcagccatcggatgagcggcttgtttagcgcgcgcttgcgctttacgcgcttcacgggccgcgatgacggcgctattgtctggcagactacccgcctgaataaccaccggttgcgtggcctgcgcctgtttctcttttacccgcgccagcgcagcggcaatggcatcctgatcttttgccgctggttgtaccgctgcgctcttgtgacgtgcaaggcgggcggctttttcgcgctccagtcttgcctgacgagcctcaaaacgcgctttggcttcggcggcgcgtttttcttcaagcctgatcgcattaatctccgctttttcctgacggaaatattggacgagcggaatattactcgggcagacccaggcgcaggcgccgcattctatacaatcagcaatatggtgagcggtagccttgtcatgctgctgccctttgctgaaccaataaagctgctgcggtaaaaggtcggcagggcaggcgtcagcgcaagcgctgcaacgaatacagcttttctcttcctgaggcgcccccatttcagtcacggatggcgccagcaggcagttggtgatttttacgaccggtacgtcaagccagggaagggtgaatcccatcaacgggccgcccatgatgaccatctggtcagcagaggggcagaacccggcatcgttaagcaaatgacgaacgggagtgccgagccgcgcccagacgttacccggacggcttatcgcttcacccgttaaggtgacgacgcgttctgtgatcggttcgccgtcaaccacggcgcgtttcacggcatatgccgtaccgacgttttgcatcagcacgccaatatcagaggagcgcccgccgtggggaacctgttttcccgtcagtatttgggtgagctgttttgcgccgccggaagggtatttggtcgggataacacgtaatgaaatatcatgagcgtcagccagtacggcgcgcagcatggaaatagcctgcggtttgttatcttcaatgccgattaatacctcacgcggttgcagaatatgcgccaggatgcgaataccttccacaatctgcgcggcgcagtcctgcatcagacgatcgtccgccgtaatgtaaggttcgcactctgcggcattgataataagcgtggtgattttatcgtcgccgccctgcaatttaacgccggtgggaaaccctgcgccgccaagcccggcaacgccatactgatgaatgcgttcaatgagcgcttcacggctgtgggcgcggtaatcagaccagccctcgcgttcaatccagcggtcctcgccgtcggcatcaatgatgacgcttaactccgccagcgccgaaggatgcgccgtcgagtggggcgcaatagcgataaccgtcccggaggtgggcgcgtgtaccggcagcattctcccacgtccacgggtaagcgcctggccgcgtagcacgcgatcgccgacgctaacgcacagctcgccctcagcgccaatgtgctgttttaaagggataacaaagcgcggcgccaaaggcacctggcgcagcggcgtgccgtttgactgggacttcatttcgggcggatgaataccaccgtcgaaatcccagattttatcttttctgaaagcggaaaatagtttaagcatgttgttccacgggaatgatgcgaacgggaatggtgttcaaatcccatttccaactgtcgggcgtctcattcaccggacgtaattcgatgcagtgcgtcggacacggatcgacgcacagattacagccagtacagagatcgctcatgaccgtgtgcatggcgcgcgttgcgccaacgatggcgtcaaccgggcaggcctgaatgcattttgtgcagccaatgcagttattttcatcaataactgccagcatacgtactggcgcggcctgctgttcttcaccatcgcatggttgcggctctacgtttagcaactctgccattttcagcatgacggcttcgccgccgggcgcgcaacgattgattttctcgccctggagacccacggcttcggcgtaggggcgacagccgggatagccgcactgaccacactgactctgcggcaaaatcgcatcgattttttcaacaaccggatcatcttcaaccgcgaatcggcgggaggcataacccagaatggcgccgaacaccagacccagaagggtcagggcgccaacggcaatccagatagtattcattacaacttcaccaaaccactaaagcccataaaggccaaagacattaatcctgcggtaatcaatgctatcgcgttaccacgaaaaggggcgggcacatccgccacggcaaggcgttcgcggatagcggcaaacagaaccatcactaatgaaaaaccgacggcggcggaaaatccgtacagcgccgactgaagaaagtgatgaccgagattaatattcagtaacgctacgcccagaaccgcacagttagtggtaatcagtggtaagaagatgcctaacaagcggtataacgccgggctggttttccgcacaaccatttcggtaaattgcacgaccacagcaatgacgaggataaaggccagcgtccgcagataaatcagatccagcggaataagtatccaggtgtcgataagccaggcgcatatcgacgccagcgtcatgacaaaggtcgtcgcgaggcccatccccatggcggtttccagttttttggatacgcccataaagggacaaaggcccaggaatttgaccagtacaaagttattgaccagtacagttccgacaaagagcagcaggtaatcagtcatgtttcggcctgaaataaaaaagccgcctattatctgtcaaactaccacaggcgacaacaggttaactgtagggttattacggattaacaaacgttgttttaacgcgcgctgaacgtttgagataaggcacaatgagcgccgtcgccaacagtgggaagagtaactgacgcacggcaaaggcatctgagacgggcgaaaaggcaaatgctttaaccgccagtaacaccgacaccagcagccagataatgtaatgctttggcacgcagcgtctgcgcttgaagaatgcgatcgtcaaccacaaggtatagtaccacatggcgatagcggtaataaatgaaatgccccatagcagtaaattaccggtttcctgtccgctaagcgttttgaacgtttgcggtgtggcaagcgccataacgtagagtaataacgccagcgaggcgctcaacaacgcgactaacagccaggctaacgggccaagaagccagcctccaattcgttgtggcggtgttgtagtcatatcttctccggggttacgcgcgttaacggtcatgccgctcattttggggcaaatattataaggtttttgatgttaaacgctactttctttattgcacatagcgccagacggattgcggaacctgacctacatcaaacaggcgtcctccggaaaccagctcggcacggcggtgatctgcagcgcgatacatattaacgatgtccatgtcatcagtaagggtatagttaaggtggtcgaacagtttttccagactttcgagcgaactaattttgcggaattttaatagataatcctgaacagtcatataaagttgatccatattaaatataatgccaacggagtagtcactgataaaaaaataaacaaaattgcaccagtgagaggtcaggggtgcaggtaaaaagggaatattcttaccggtaaagagtcaggcgccacatggcgcctggggcgaaaggttaacgcgctttactacaacaggcaataaacgtcagaccagatagaacatatttcgttttttttgccggtttttgacttttctttgcacgccccggggcgctgcttaccgtaccgcgcgaaaatgcctttacattatctgacgcttacttcttctgaacggaagccgtgggctcaggtggttggtaattgtcaatatggttggcaatacctaaaagaatgactgagataatgagaactatccacccagttaattcaataagacgattcattattgacgacatttgctttgatttatccataaacacagagagtaaatgttactttcctggcgaacggtcggcaagagggaggggaacgatttcagcctctgttctgtaacaagttaatcatttgatgctacgttgatggtcaggacgctattgcggctagtcgcacgatggtgtggaatagcgatatctaaaaccggaggcagtgagatgaatgacaaaatccgcgttgggttaatcggttatggctacgccagtaaaacctttcatgcgcccttaattatgggaacgccagggttagagcttgcggcggtatccagcagcgatgaaacaaaagtgaaagcagactggccggcggtctccgtggtctctgagccccgacatttatttaacgatccgcatatcgacctgatcgtgatcccgacgcccaacgatacccatttcccgctggcgaaagctgcgctggaagccggtaagcatgtggtggttgataaaccctttaccgtgacactgtcacaggcgcgagaattggatgcgcttgcgcggagcactggtcgggtactttccgtcttccacaaccgacgctgggacagcgattttttgacgctgaaggccttgctggcggatggcgtgctcggcgaggtgtccttgtttgaatcccactttgatcgcttccgtccccaggtgcgcgaccgctggcgcgagcaaggcgggccgggaagtggtatctggtacgatctggcgccgcacttgttggatcaggccattcaactttttggcctgccggtcagcatgacggtggatttagcgcaactgcgtccgggcgcgcaatctacagattatttccacgcgattttatcctacccccagcgccgcgtgattttgcacggtacgatgctggccgcggcggaatccgcgcgatacatcgttcatggttcgcgcggtagctatgttaaatatggcctcgatccccaggaagaacggttaaaaaacggcgagcgtttaccgcaggaagactggggatacgacatgcgtgacggcgtattgaccctggttgagggagagacgcgcaaagaagagaactggcttacgttgccgggtaactatccggcatattatgccgccatccgcgatgcgttaaacggtaacggtgaaaatcccgtgccggcaagccaggcgattcaaattatggagttgattgaactgggcatggaatcggcaaaacatcgcgcgacgctgtgtcttgcctgagatgtcgcatttctccgcctgggatagcattaaaccgcaggcggagaagagcgttagtgtcaataaagcaatcttacgccgcggccactttttcgcgtagcgcacgtttttcgctatcgctcagaaaggcgatttccagaccgttaatctgcgcctggcgaatctgttcgcggctcaatcctgccgctggcgcggcgacgtgatattcatggataatatctacgccctgaacagccggatcgtccgtattaagactggcgagaacgccatgctcaaggaaggtttttagtggatgatccgccagcgatgcgacggtactggtctgaatattcgaggtcagacaggattcaataccgatacgctgctgtgcaagaaaatccattaacgcgcgatcttcgacagcttttacgccatgtccgatacgctcggcccccagttcgcgaatcgcctgccagatactttccggccctgcggcttcgccagcgtgaacggtaatatgccagcccgcatcgcgcgcccgattaaagtgcgacaaaaacagactgccgggaaagccaagctcatcaccggctaaatccagcgcggtgattttctctctgtgcgccagcagcgcatcaagctcctgtaaacatgccgcctcgccgaaggtacggctcataatgccaatgagtcgtgcctcgacgccaaacgtgttacagccgtcgcgtacaccgtcgataacggcttcaaccacgcctgcgatcggtaactgatgcgccatcgccatatagccgggcgaaaagcgaagctcgacgtaatgcaggccgttacgtgccgcatcttcaatattttcaaaggccacacggcggcaggcgtcaagcgatgccaggacttttaccccccaatcgagtttagtgagaaagcttactaaatcgggttcggttgaggtgacctggacatgcggaatcagcgtttccagcgtttgggcgggaagggcgatgttgaactgccgaccaagatccagaattgtttgggcgcgaatgttgccatcaaggtggcggtggatgtcagtcaaaggaagcgtaatatcaatcatgggcgcactcaatttttaataaaagtgcgcaccattatactacagattgataatgctctggaaattttgcaaaaacggagtcattacgttgcaacttcgcgagagcgcgggagaaattttgtatcattctctgtaacgcgcccccggtcagctcacgggggttgtctctgttatcgcctctcaggataaagggtcaaccccccgcttgtagacggtatcagcgaacggcgcggtggcaaaatccatatccgagatcgtaaaggggagcagatcggcttcgccaaaacgatcggcgacataatcccactacgtacaccatgtcccgcgtcggtcaacttcctgtgaaaaatcgaacatatcccttccttatgcctgaacggtattcatcaggccaaccatttcatcttttaccgactgaacctgcgggccgataattacctgcaaattatgctgattgagctgtacgatgcctgtcgcgtgattgtccttcaatgcctggacatcgacaaacgacatatctttcactgacaggcgtagggggggatgcagttgtccagactcacgatgttttccgtgccgcctaatgctcacgacgagcaccatgtgcggagtcaaacgatagccgctcgcctggtaacgcaaaagtagaggctgcgcgtcgttcggcgcagaccgggtgcagcgtcgcgacacccggcaaggcgattattgttgaggcagcgccggaacgtccggaacggaaagcgccggcatcccaaataggccgacaaagtcttccaacggcattttttgtccgttgagcgtgatctggccattggcgtactgcaaactggaggcgatagtattatccttcagcgttgtcagtcggaacatctgacccattgcggacagcccctgcacctgctgttttgccagtttttccgcatcatcctgctgatagccttccagttttgctatctgcgtcataaactcgaccgccatgtccatcggaattgccagtttcgcatccagcgatttcacggagcggtcgacttcctgtgccagcgtttgcggttgtgccgttgtggttgccggatctttgaggaacagcgacagattcagcgtggtttcccctttggcgtttttccagctaagcggcgccagggtcagaaccggatcgccttttaacagcacggggagagcgctaaagaacgcttcagtgactttttgctgataaagctcaggattctgcgccacgtccggctgattcagcagcgcctgcgtttgcgcatgatattgctgactaaactggtgccaggcttcgccgtcgatttgaccgactttcagcgttaatttaccgctgcccaaatcctgattctgcactttcaggctgttaagcgagtaatccaactggctgttaatggtttttccgtcgttgacgagatcggacttgccggcaatttccatcccttccagcaccgccatctctttaccctcaatggcgatggacagtttatccagcgttaacttttggtcgcctacacgctcgccaaagcttgccagcttactggtaccgtctgttttcaaattattaaaggtgagttgtaccttctgattatattcgttaacggcatcgaccaggccgctctgcgcttcgcccgacagcgaaaccacattaccgtctttatcggcgttaagctggaactcgccgccgctaaaggcgaccttttcaccggcattctcgtagtttaacggcttgagagagatatcggagcgggtatcgccgccataaccaatgcgggtattgataacaaagggcgcgtcgcctttcgcaatatcaaagaggggttttgccgcatcgttattcaccagagtggtttttaccgacgccatagaagggatcagattgagcgttttgagctgggcgagcgggaaggggccatgtgaaacggactcgtccagcacaatgctttgcccgggcttcaaccaggtattgtctgcgccggcaaccggtttgacaaccagttgcagatggctactgaacacgccgcgctggtagttttgataacttaattcgacaccggcctccggcgcagtacgcttgagctgttcattggcctgagtcaccatttctgcaagatggttctccagctttttccccgtataccaggcgccgcctgtccagacgatgccaagtgcaattactacacctgcagctaccagtgtttttttcatatcaattgtccataaaaatgaaaccaggcggattaaaccgcctggaggagttttacgtctgttataagcttagcaagagttgttaaaaaattcagtacgttgctacagcttgttataaacacgcgctaaacggcccgtgccgctggcgttaaccggagactcatccgcgccgataaaggcagattcacccggcttcagtaccagacgctgttcatctttacgtaacaccgcctcaccctcaacgcagaacagaatcgcggcgctgtgttggccgatgctcgtctcctgaagcgccaggtcgtgcagtgaaaaagcaaaatcgtcaaccggaattgggaagtccagctccgcgccgcttttcaccggggcagtcagcaactcgccggcaggcttaggttcgaacttcacgttcgcgaccagctcagggatgtcgatatattttggcgtaaggccagcgcgcagaacgttatcggagttcgccatgacttccagcgcaacgccctgcagataagcatgaggcgtttcggcaaacaggaacatcgcctcgccgggattcagtttgaccacattcagcaacaaaggagagaaaagcccgctgtcgtcaggataatactctgaaatcacgcggatcgtttgccacggttcgccttgctggctgttaagcgccgctttgagtacggctaacgcgcgggatttttcttcgccttgcatattcaacaggctggcgaaaagctggctcagacgttcagcattcggcgcctgcaaaaagtgggcgatagcggaatgcgcgccggcgacaggttgcagtaaagagacaatgtcagaaaattcgcggaacgcgttcatcgccaggaaaggcgccagggcaaaaaccagctctggtttatggttaggatctttatagttccgctctgcggcatccatggggatacccgccgcattttctttcgcgaaaccgatttcggaattgcgcttattcgggtgcacctgaatagagagcggctgcgcggcgcacagtactttaaacagaaacggcagttcgccgaaacggttggctaccgcttcgcccagcatggcggttttattcttttcgatggcgtcacgcagggagacggtttcgccgttggcggtggtgattcgcgagctgcttttgggatgcgcgcccatccagagttcagccattggctgctgctgcggattggcgatgccataaagttccgttaacgcagttttacttccccaggcatagttttgcactgagttaatgagtttttgcattatcaagccctgtttcaatgtggagatcaatgggaggtattaaaccaagaaacccgcatgaagtaacctccgggcgtaaaaagtcgtacttgtctcagtttttgttaaaaaattgtgtaggatagtgtaactcgctttgagtcgggcaatggaacacctgcccagagaataaccataccgagcggtaagtgagagcacaatgtcaaacaaacccttcttttatcaagacccttttcccctcaaaaaggacgataccgagtactacttgttgaccagcgaacatgtttccgtcgccgagttcgaaggacaagagatcctgaaagtcgcgccggaagcgctaacgttgttggcgcgtcaggccttccacgatgcgtcttttatgctacgtcccgcgcatcagcagcaggtggcggatattctgcgcgatccgcaggccagtgaaaacgacaaatatgtcgcgctgcaattcctgcgaaactccgatatcgcggccaagggcgtgttgcccacctgccaggataccggtacggccattattgtcggcaaaaaaggccaacgcgtctggactggtggaggtgatgaagcggcgctggctcgcggcgtatataacacctatatcgaagataacctgcgctattcgcagaacgcgccgctggatatgtacaaagaggtcaataccggtactaacctgccggcgcagatcgatctctacagcgtcgatggcgatgaatataaattcctctgtatcgctaaaggcggcggttcggcgaataaaacctacctctatcaggagacaaaagcgctactgacgccgggtaagctcaaaaattatctcgtcgataagatgcgtacgctgggcaccgccgcctgtccgccgtatcacattgcgtttgtcattggcggtacctcggcggaagcgaacctgaagaccgttaagctggcctcggcaaaatactatgatgcgctaccgaccgaaggcaatgaacacgggcaggccttccgcgatattgagctggaaaaagaattgttgcttgaggcgcaaaatcttggcttaggcgcgcagttcggcggcaaatatttcgctcacgatattcgtgtcatccgattgccgcgccatggggcatcgtgtccggtaggtatgggcgtgtcctgctccgcggatcgaaacattaaagcgaagatcaaccgggaagggttctggatcgagaagctggagcgcaatcccggtaaatatattccagaggcgctgcgccaggcgggagagggcgaggcggtgcgcgttgatcttaaccgtcccatgagcgagatactgcaacaactgtcgcagtatccggtatcaacgcgcttgtcgctgaacggcacgattattgtgggccgcgatatcgcgcacgctaaactgaaagaacggatggacagaggcgaaggtttgccgcagtacatcaaagatcatcctatctattatgcggggccggcaaaaacgccggaagggtacgcctccgggtcgcttgggccgactaccgcaggacggatggactcttatgttgatcagctccagtcgcagggcggcagtatgatcatgctggcgaaaggcaaccgcagccagcaggtgaccgatgcctgtaagaaacatggcggcttctacctgggcagtatcggcggcccggcagccgttctggcgcagggcagtatcaagcgcctggagtgtgtggaatatcctgaactgggtatggaggctatctggaaaattgaagtggaggattttccggcctttattctggtggatgataaaggtaacgatttcttccagcagattcagtcatcgcagtgcgcgcgctgcgttaagtaatgtcgccgccctgcggggcggtaacatgattcgctattttgccggagaacggcgcaagcgccttatccggtctacaccgttgtgttgttatcgttaatactcataagaccgcaaacatgtgagcaatgtcgacacatgatctcatcaacttgagtaaggagcaggtaatggtaacggtacgccgcgagaaagattcaatgggcgtgattgaagtcccggcagataaactgtggggggcgcaaacgcaacgttcgctggagcattttcggatttccacggagaaaatgcccgtctcgctcattcacgctctggcgttgaccaagcgcgccgctgcgaaggtcaaccaggacttagggttgttggcggcggaaaaagccagcgcgattatcgaggcagctgatgaagtgctggcgggaaaacatgctgatgagtttccgctggcgatttggcagaccgggtccggtacgcaaagcaacatgaatatgaatgaagtgttagcgaaccgcgccagtgaaattttgggcggcgttcgcggtatggaacgcaaagtgcatcccaatgatgacgtcaataagagtcaaagctcaaacgatgtgttcccaaccgccatgcacgtggcggcgttactggcgttacgcgaacaccttatcccgcaattatccgcattaacggatacgcttcgcgataaatcccacgctttcgccgatattgtcaaaattgggcgtactcacctgcaggacgcgacgccgctcaccttaggccaggagatttccggttgggtagccatgctggaacataacctcagacacattgagcacagtttaccgcacgtcgcggaactggcgctcggcggaaccgcagtagggacagggcttaatacccacccggaatatgcccggcgcgtggccgaggaactggcgaccattaccgcggcgccgtttgttaccgccccgaataaattcgaagcgctggcgacctgtgacgcgttggtacaggcgcatggcgcattaaaaggactggcggcctcgctgatgaaaatcgccaacgatgttcgctggctggcatccggcccgcgctgcggcattggcgagattgctatcccggagaatgagccaggcagttccattatgcctggtaaagtgaacccgacccagtgtgaagcggtaacgatgctatgttgccaggtaatgggtaacgatgtggccatcaatatggggggcgcatcgggcaactttgagctcaacgtctatcgtccgatggttattcataattttctgcaaacggtgcgcctgctggccgatggcatggcgagtttcaatcaacactgtgcgtcaggaatcgagccaaaccgcgagcgtattacgcagttgctgaatgagtcgctgatgctggtcactgcgctcaatacgcacatcggttacgataaagcggcggagattgcgaagaaggcgcataaagaagggctgacgctcaaagcctcagccgtggcattaggataccttagcgacgcggagttcgacgcctgggtacgtccggagttaatggttggcagtatgacgccgggacgttaatccgccacatacaggtgcagtcgcggaataatcagtcgcagcggctgcgcctgtggtttaaaacggtgctgaatattatcggcgtcatagttttccagcccgccaatatccggcacgccagcgccgttgtccgtgttgattaatgcgataatcggcgaggggcaggcgtgttgcacctgtttctgctggcctttataccagatgcgggcgatcggctgtaccttaaccgggcgcttaatcttgagtttggcctgctgcggtaaggcagcgatatcctgatattcccgttccagcttgaattgccattgttcgcgcgtccacggcgggacgctgcgcggcgacgcgaggctttttttcaactggctcagaacctcatcccggcttaaatttttaataatatgtttatttgcccaaccgaaacgtatggtggcggggttattgataagcgtcagcgtgcggtaagcgttcagcgtaattaagccgggtagatgccgatgcacccactcaaaacgtgccgctgagggaagaccggactctaccgtaaccatctgctcgaaggtggttttcaactggttaatgcgctgtacctgattttccagatctaactgtgtcgcattatccacttgatagcataaaacgccaggcaggcggacggcggctttactgctgcggttttcggactgctgttgaataaacaaatggcgatagtgacgtagcgccagcgcttcggcctctttccccagatgttgcgtgacctcgatagtgtccagcggcgcatgttccgcctctttggtcacctgcggcagtgaaaagacactagcgataagtagcgaatgctgctgtagattatccgacagcgccgccaggtgttgttctatctggcgaaaagtgccattcaggcgttcaacgagatcgtagcgggacatggtatcactcactttagttacaacatactatctgtatagcacaattcccgcggctcaaccagcgtgcaaaatacgtcaggccgcggtcatgtcgggcatcgcgtgccagaccggccagcgaaagctaaattttgcgccgcccagttcgctatcgtcacagacgacgctaccgcccatcgccagagcgatagagtgtacgatggcgagtccaagcccgcagccgcctgtcgcccggtctctactggggtcgagtctgacaaaaggttcaaatacgcgctctcgcgcatccgcttcaatgccggggccatcatcttcgactatcagcgttgcctgactgccgtcaagtaacagactgacctgaacggtggtacggctgtagcgcaacgcattattcagcaggttatccagcactcgcgacattaaccgcatatcaagcgcgccataatcgccgattacacatgtgagaagatttacggcgcgttccgggttcacgctctgcacatcctgcaaatgcgcgaacaaccaggcggggaggtcgggtttggtcaacatcagttcattttgtggtcggtcaaggcgcgcataggtgagcagttcttcaatcagcgcttccagttgaccaatatcgcgattgagcgcctgtgattccggcggagtcagattttcactcatttcaagccgatagcgtaaacgtaccagcggcgtgcgaagctcatgggcgataccgtcaatcagctgttttttactggcgatcagagcattaatgttatccgccatctggttgaacgcgacgcccagacgttcgaaactggaaccattatcgaaatgcaggcgttcagtcaaatgaccctcgccaaagcgctgcgcggcggattcgagcctgagcatttcttgccagtgcgggcgcatccagataaacacaggaaaggcgagagaaaaggcaatgagcgccattaaggcgatatccagcagtcgcatttgatgcaggaaatagagatagggaaccgggccaaccgccaggacgtaatggctgcgcgggatacgctgaataaaggtgtattgatcgtcaagcgcgacaatatcgccttcacgcagtcgctgcgtggtggcggcatcaagcttatagtgatttaacggttcaacgcgtaaatcgaaagagaggttcaggtccatctcttttaacgttttcccccattcacgcggcggaatttcccgcagttcgctgcgcatcagatagagcgaacttttcatcagatcgtcgagcgattgcctgcccgcgcgttcggcagtgaatttgtacaccagtccgaccaataaggtcatgaccagaaaacagacgaacagcaaaaggtaaaactgcacaaacagctttttcatcaacgcccaccggatctcaatacattagctctatcgcgcgctgacggaaaagatttcccgtcagcgccgctggtgggttataaaagcaggctttgcgtcaactgacaacctcattgtccggcgttaaggtccggactttcgtgaacaatgcgtccatcgacaagcgtcaaaacagcgcgaatggtatcaattctgtcttccggcatcgtcataaagggctgattgagcaccgccagatcggcctgttttccgacgctaagctggccccggtgttgttcggcaaaggcgagccaggcggcatgacgtgtatataacgctagcgcttccagacgcgtgagccgctcgctggcgggtttacgcacggaaccgcctgacgctataccggtgatatgatattcgatagcgtgccagacaccggcaatgccaatacgcgtcgaatcggtgccgccagctacgacaagccctttatccagcgccagtcgaaccggcggcgaattgtccgtcgcaccgggtgggttggcgtcacggatggcaagcccctcaaagtaaggccccatttgcacagtgtatgccagacccagcttacgcattcgctcaagtgtctgtggcgaaccggtattcagatgcgcaatagaccagcggagagggcgcagatcgtactgctgcgctacctgctcaaaaatcgtcaatatcgcgtcggcgctgtcatcggtataggcgtggatctcaagcggtattccccgttttgccgcaaacgtcgcgacctggcgaagcgcggttttgtcctgctctgaggaagaaaaccctggggccatccgcacgccgtcattcattcctgccaccaggctttcccccaggccaagaaaagccagttgcccgtcgtcggcacgcgccgggcgaaaggccatcaggttgctgaaccactgcgcttcatgacctttcgcttccggctgtaccggaatgcgataccccacgcgcagcggtaaatccccctggtttcgcattgcaaataaaggctcataagcggcggcaggcccggcagaggggtcaatgatgccggtcacgccgcgagcgttcatatcagcgaaaaattgtcgcagaccgccctcgcgatcggcgttactacttatgctggcaaaaagctggttaaacgcggcgatgtcaccaaataatttccccgtggcgctaccttttgcgtcgcgctctacgcggattcccgctaaatcaggaggaggggtgtcgttaaggccaagtacgtctataccgcgctgattcactaacgcatagtcgtaaagatactgaatataagccggatgatcgggaagggcgtggctcagttcggctaccgtcgacgcccggttttctgcaaattgcgccggtatccatgatcccactacggctacccattgatcgtggggacgacggttagcgtcggcgcgtaatttatccagcgcgtctttaagcgaagggctgtcgtaccagtaggtttcgaatgtccaggtttgtccgccgcgaatggcgtgaatatgggtatcggtcaggccgggtatcacggttttaccctgtaaatcgatggtacgggtatggtcgccgcgccattcatttgtcgccgtatcatcgccaatcgccacaatccgcgagccggaaatcgccagcgcgctggcctgcggctgggcatcattcagagtgatgatattaccgttatgcaaaataatatccgctgccgggcgggcggcggtggctgcgcctgtggccgtgagcagaaagagaagcgcggttctggaaagcagaggcgggacgagactgatcattagcatgttccttttgtcgggagataagcaaaccatagagagcgaacaagaattgttcaatctgtgcccagggaacagtgcgttctgtttttagaacggtggtgatagaaaaagaaaagcccgccgaaacggcgggcttgagaagaattaatgaataattagaactggtaaaccatacccagcgcgacgatatcatcagtgctgataccggcatctttatagaacgggtcgtcgtcatccagcaggttgattttataatcaacataggtggagaagtttttgttgaaatagtaggtagcacctacatcagcatatttaaccaggtctttatcatcgccattaacgttgttataggtcagatctttacctttagacatcaggaaagaaaccgccgggcgcagaccgaaatcaaattgatattgggctgtaacttcgaagttttgcgttttgtttgctacgccgccatcataacccttgtccgttttaccataaggcgtcatattacgggtttcagaatacatagtcgctaaatagatgttgttggcatcatatttcaagccagctgtccatgcatccgctttgtcgccgccagcaatcgtgccgccagcattgacttgctcattagtacgatcggaagtggtatacgcagcgcctgcgctgaagcccatgccaatatcataggtagtagaaataccgaagccatcaccgttatcgtaacgaatatcgtcgccattattacggttattggtaccgatatttacatcgtcagcgctttggctttcatttttaccctgatattgcaacgcgaagttcagaccgtctaccagaccgaagaaatcagtgttacggtaggtggccacgccgttagcacgaccggtcatgtagttgtcagcgtaagtataggagtcgccgccgaactcaggcagcatatcggtccagccttccacgtcgtacaggacgccgtagttacgaccatagtcgaatgagccgtagtcgccgaatttcagaccggcgaatgccagacgagtccaggagttcgcgccttcgccttcggtagtgttagcctgaacgttatattcccactggccgtaaccggtcagttggtcgttaatctgcgtttcgcctttaaagccgacacgcatataggtctgatcgccatctttagaagagtcatcagagaaatagtgcaggccgtctactttcccgtaaaggtccagtttgttgccgtctttgttataaatttcagcggcgtgtgctgcgccagcagccagcagagccgggatgacaagtgccaatacttttcttttcatttttttatccttaaaaacttaacttatttgcaaaagattgaacttctacagattcgttgaatcaaaggcatcctaatctgaataatattatttcagcaaatgctaacttttcttatatgttattaattaatacaaaagttactatcggaaacgcatatatttatggtgaatatgtttgttattatatattcatggttgtgatttgtttgatttcacaatttgcgaaaaaagatggcaatatagcggcgggcagacattctgttatcaattttgtgaactggcttcgagttttttttaatttaattttcttgagcgaaaaagacgtaatcatgaaccgcaacgcagagaaaacggtaataaaggggctgttccgactaataaaaatagcactgatgtatacggtgtctgttttttgaacagtggcggtgatgagcatcgccactatgacttgataaaggcaggtaaaatctgtcgactcacttatcccgtcgtttcgtcccaggcatgaggggcaaaaagatagcctttattgcgaatggtctttatacgatagggctcagcagcgctatccagcagtttcttacgcaggcgggaaatcgccacatccacgctgcgatccagaccatcataattaacgccgcgcagcgtttttagcaacgcgtcgcgatccataatttgtccggcgtgtgtcgccagttcccagagcaattcaaaatcggcggtggagagcgatatgaaatcgccattgagctggaccgcccggttaaggggatcgatggttaacgcgccaaaacgcagcgctttatgcggcgtaagcgcgctctcctgaagactttttgcctgttgcgtttgttcgctttgccgcaggtgtaagcgcagacgcgccagcaaaacggccggaggcgtggttttgaggatgtagtcgcaggcgcccatctccagcgccagaatatgattcatatcactgtccagcgaggtgagcaggacaatcggaccttgccagcggtggcgtaaatcgcggcatatcgtcatgccatctttacctggaagcataatatccagtaaaaccagatcgggctgagtgatgaggataagatcctccgcccggtcaccacgcggctcaacaatgacatcaatatcatgtttcgccagataagcggcaatgagagaacccacttcagcgtcgtcttcaacaaatacaatgcggttcatattataaatggagaatagaaaacgccaacatacacctcctctgttttcccttccataaatcttttctaaacgagagcggttccgttatgctacatgctgttgttattagcatgttaaggcaaggtaatgggactcgtgattaaagctgccctgggggcgctggtcgtcgtattgattggtctgctgtcaaaaacaaaaaattattatatcgccggattaattcctctgtttccaacgtttgcgcttatcgcgcactatatcgtggctagcgagcggggcatcgacgcgatgcgtaccaccatcgtctttagcatgtggtcgatcattccttatttcatttatcttgcaacgctatggtatttcagcggcgtgatgcgcctgcccgtcgcgcttggcggtgcggtggtctgctgggggctaagcgcgtggctgctgattttttgctggattaaatggcattaatattggcaaagaccgtggtttccccatcgtaatacagacggatattacgatagggaggttgttaacccaccagcatccacgtagccggaaccgccgcgaccagcaataaaccaatcagcacgacttcctgacgatttaatacattgtcatgcttgtgcgtccgacgcgcatacaggaaaaccagtaatccaggcgcgtacagtacgacggacagcagcaggtgcatagggcccgacgcatataataaccataagccataaatacaggctccgataccgaccgcccgatggaggggacgcgttgcaatcttcagcagaaatgcgccgaccagaaagtagggcaccagaatcatttctgacgcaatcgtcaatagtgtgttgtagtccgaaccggtcagccagatcagcaccagacagatttgcacacagatgttggtgagccataacgacgcagaaggcgcgccttgcgcattttgtcgcgcgaagatgcccgggaaggatttataggctgccgccagaaacggcacctctgccgccatgatagtccagcttagataagccccgcagacagacacaatcagtcccgctgcaataataatttctccccacggccccatcattttcaccatcagaccggccatcgacgggttgcgcatctccgccagttccggacgcgcaagaacgccaagagaaagcagcgtgaccaggagatatattcccagcgctgcgagtaccgccagtagcgtggcgcggcctacatcgcgtttatttttcgctcgggccgagacgacgacggcgccttcaacgccaataaacacccacagcgtaataagcatggtgttcttgacctgttcccatacgggaataccgagctcaacaccggtgaagtccagtgtgaaggtatccagtttgaacatcatgatagccagcacaataaacgcgccgagcggtaacagtttcgccagagtcgcgaccagattgatgctggctgccgtttgtacgccgcgcaggatgaggaaatggacaatccagagcaggactgaagcgccgacaatagcctgccaggtattaccgtcgccaaacagacgcagggcaggcgtatcggtaaagaaactcagcgctgaaaagacgataaccaaataggatacgttggcgatgaccgcgcacagccaatagccccaggcagaacaaaagccaatcagttcgccgaagccttcgcgggcgtaagtaaagatgccgccgtcaagctcggagcgaatgcgcgtaaggattaacatggcgaatgccagtaggagtatccccacgccggtaatggcccagccaattaacaacgcagccggactggcaacggcggccatattctggggcagactgaaaacacctgcgccaagcattgagcttaaaaccagcgcggtcagcgcgctcagtcccagttttttttccattggtatccagctataaaaatgaaattggaagaataattattatggcaaaacgcataaaaatggtgaaagccactaaggcgcgggattttacggagagaagggaccgcatgcaacggcctggataagatttatcgccaaaaaagcgaaaagtgagattcatcgcgatatttgacggaactggcatcccgcgagaaagcctgattgatgcgccgcgcgataaacgtacctatttccgtgagataaattacatcgccgcggcatttcaatatcagaaaaagaattacaactcagcttgagtttgaagttcctctacagggtgataacgataaatcgtcgatataccgatatcgtaaataattgccaactgtttcctgctatagccatttttgatcagccttgctatttgttcatgttgctcttttgtcagtttcggacgacgtccaccaatacgcccctgtgcacgtgctgcttcaagtccggccagtgttcgttcaactattaattcacgctccatttccgctaaagcccccatgacgtgaaaaaagaaacgtcccatgggtgttgacgtatcaatgctgtctgtaagactacggaagttaacccctttttcccgcagttcctcaataagagtgatgaggtgtttcatgcttctgcccagcctgtccagcttccagacaacgagcgtatctccttctgataacgttctgagcagctttttcaatcccggtcgggctgactttgttccgctgattttatcctcaaaaatcagttcacatcctgcgcagttcagtgcgtttcgttgtaaatctgtattctggtcatttgttgacacacgaatgtagccaatttgcatgaaaaatatcctctttgttttgttaaaaatacatagctggtataggtgggagttaagacgaaaacgttggtttgggggaaggctctgcactgcccgttggtgtgcctgttccgtggccctcagccacaccgccagcagggtggctgaaatgtaacggagcagcattttcttctgaaatgtaccccaatctggcaaaggcttaccccgcgaataaattaccggatttacggggtgagtttattcgtggctgggatgacgagcgcgggattgatcctggtcgccagttgcttgagtggcagaaaggtactttggttggtggtagagatgacaatgatgccgcagttgatatttcatatatgagtaacggaaatagtattgattacggtggcgataaaacattttcaacgaattaccggagtgattatttatggtatgcaattctgggtaacgtcactggtcgtgccaaagctgctttaagtgggtccttttttaatgtaactcgtccacgcaacatcgcctttaactacattgtgagagcaacatagaaacgttggtttgggggaaggctctgcactgcccgttggtgtacctgttccgtggccctcagccacaccgccagcagggtggctgaaatgtaacggagcagcattttcttctgaaatgtaccccaaactggcaaaggcttaccccacgaataaattaccggatttacggggtgagtttattcgtggctgggatgacgggcggggaattgattcagggcgttccttgcttaatgcacaatcacattcggttatagatcatattcactatatggagttatggactggtgaagggcttgccgcaaatagcacccgtgcaggaacaaaccctggtatactggctacatacggtgatggcgggattgttaaaacagatgagtcaggtgtaaaagttccatcttcactacgtgctattggcactcgtggtgtttatagattaggtgccaacggagggaatacaggaacggaaaaccgcccccgtaatattgcgtttaactatattgtaagggctacttaatgaataatgctgctgcagtacttgatcagaatggtatcgctataactgcaggcgatattaccgtttataactacgatgctgaaaaccgtgaatatctctctgccactgttgagtatctcgcttatggtgttggaattccggctcactcatgcattgacgcgccaccagaaaaacgccccggcttcgctgtctgtcgtgataccgaccagaacatctggaaatatgttccagaccacagaggcgaaacggtttacagcacagagaatggtaacgctgtgcaaatcacacaaccgggagattaccctcctgatacgacggtgaaacagccagctactatctatgatgtctgggatggtgagacctgggtgacagatgcgggacgacagcacgcagcagaactggaagctgccggagcgcatcgtcagcaacttgaggaacaggcaatggcatctgttgagcttataaatctcaaactacgagccggacgccgattgacgccccaggagacggaaaaactaaacgccgtgcttgatttcatagatgtgcttaatgcgactgacatcagcactgcaccggatatcaactggccggaaatgcctctggcagcagccagttgaatataactaagccgccctcacgatatagttaaatgcaatattgcgggggcgggtttcactaccacctgtgttaccaatacttcctcgtgaatgaagcgttggtgatggaatcaaactccctcctgtatttgtggcatcaagccccctgccttgtgtatatgtttttttgaaaatcgtggccaactcccattcatcttttgtgtcatatccatcgttagctacaacaatatggcggtgtttttccaacatcccgttttgaatgctcaataaagcgcgtgccgcatcaattcctcgcccatcatcccagccacgaataaactcaccccgtaaatccggtaatttattcgcggggtaagcctttgccagtttggggtacatttcagaagaaaatgctgcgccgttacatttcagccatccctctggcagtgttgctgacggccacggaacaggtacaccaacgggcagtgcagagccttcccccaaaccaacgtttctatgccgcccttacgatgtaattaaacgcaatgttacgggggcgggtttcagttgcgccgacaatactggtacttagacccgttgctgttcgtttgttatttttattcccttcgatcagacagttgtaatcgtcattaccaattaacgaattggtggcatcaataccgtccggtgacaaggcattagttgtggaacttaaagtcagcatctcgtctgaacttggaagattttttaatgggatttcattgcgtgaaatacccgcataaaaaaaggactcatgcctgtgcgcttcaaaagagtcatcctgaagccttagcaaggctcgccccgcatccacgccacgtccgtcatcccagccacggataaattcaccccgtagatccggtagtttatttgtaggataagcctttgccagattggggtacatttcagaagaaaatgctgctccgttacatttcagccaccctgctggcggtgtggctgagggccacggaacaggcacaccaacgggcagtgccgagccttcccccaaaccaaggtttttgacaaacagcgcaggctcaggaatatctgcgccgttctggtctttagccagcttttccgccagcttgttcagtaccgtagtcgcaaagtttggatcattaccgagagcgtcagccagctctttaagcgtatccagtgtctcaggggcgctgcctgcaagtgccgcaagtgctttggccacaaactccgtcgtcgccagctttttgctgttatcaccatttgcaggtgtaggtgctgttggtgtgccggtgaatgtcggactggctttcgtcgcgtactgggtatgcgggtcaactgccgcgatatgtgcagccaggtctgttccgcttttttcgaccttctgtttgaggtatgacgttcggctggccagttgtttagcctggcggttagaaattccgtcaggtccgcccagaacggggtcagagacctcaatctggtagatgccgctttcccactgcggggtttcgggtagatttgccataattaactgctcccgtggttgtaactaccgtcataacgggtagtactgttgtatcgaatggcgacagactgatattccagacttgccagatgacagcgagccggagcaaaggcagcaagcgtctgacgtaacagcgccgcctgatcgttagtgatgggttgttgaaggatgacgcgatagactgcccaggcttgtgcatcaccatggacgaaaagcccgttgtacgtgtgtctgccgtcatagccaatctgccccgtaccttcaatcagatccacttcgccgaagccaaaacggcggataatttcccggattgaccacggtgttcctttatagcggtgtagctcgatagcggatttgataagcatgcggcgtacatcgtccgattccgccagttcccagccatcgccgaacagcgagaactgctcgccaagccatggcagcgcggaactgtcgacaatatcgacgagaccgaccatcagtacgctcaggtcgatgttatccagccgtccggccagtcttcccagcgttctgagactgatatcaccctcaagcggtggcgggagttgtagcacctcagccatcggacaccccggtcatgttaagagtgatcgctgtacagtttgcccattcgttttctgccaccaccctcagtgccggtgtcaccagttcgacctggtacaccccggaaacggacaacacgctgataatctggctgggaacaatatcgcgccccagcgtggcggtacgggatgccacccagttctgtatggcgctgttagcgttgtcctttaccaaccttgcatcctgatcacgatagatcgtaatcctggcttcaatggtgtaatccacctgaacaggtgttttagcccgcacggtatcagtgagtggtctgactttttcgtcagaacagaaactctctaccagagtgaggatactgctgtccggtagaccagtgctgagcagcggatacagctcgacagtgccgggagcgggagaaagaacagcaacgtcgacaatgccgggatgcgcccccatagcatgaaaacggtatgcaccacggcttccggcattggtgaatgactccggggccagcctgatacgctcccggagccggtcatcgtcttcctgctctgaaccgccagagctggccgtcagattggtcaccagcaggtcaatgttatcaatctcatcgagtaactgactgacctgcgccggttgccagccgttgccagcggtacccggctcggtacaggtggccgtgacattgaccagcagcaatccggccttcagcaccacatctgtatcggtggcaaaaataatactgtcggaagcgctgacgcgggtgcctgccgggatcagcacatcaatggccagtgcctcatccacagagaactgaagtgtggtggtggcaggctgcgcagcaaggcggtatacgtcgaccagttcaccgaggtaatcaatcatcggctcacgggaaaaagcgaccagattctgcttcgccgcctcctgtactgccaccctgaccagcatttcgcgataggcccacaggtcaatcagcagacgttcagcctgtgccgggtacagcgtttttccggtatccgcttcatacttcgcaatcatttctgccgtgattttatcggcatcgcgttcaataaaatcgggttctgtcagcgccatagcagttcctgagtacggggttgtccgtctgagcctttccagctcacccggagcgtaagatgttcgccgtcgacggcgggtttaaccgacataagctggcagcggggttcccagcgcctgatggcatcgacggattcgcgaaccacatgcggaatggcccggccgacaggccagtcgatataaaggtgcagattgctgccgaactccgggcgatgcgggtcgctgccgcggggagtccgcaggatgatctggatggactgccggatatcatccagcccccggacgatttcgccgggagcctgcagagctggttgccagaatactgaggtcgttttcatggaggcagtattgcccccgggaagtaagcgccgatattaaaggcgtttaagaaggttcaatgggaatggtgattagagttctgaccatcagcaaatatgttacccgttgcatgggcgcttccgttgatttccagatcaccattgagtgtcgcggggccgttgatcgtggtaactcccgtgaggtcgaggtttttccctttgagagagatatcagcggcaacctccaccacgatacgctcaatacctcctctgaccgtcagcgtatgggtcgcgcggttataactgaactccgcgccatcagcgtatttcgtaccccggacgtttttatcactgaacggcggtttatcgacgtctgagtacaccgcgcccagaataacaccatcctcgccgttggcatcgagcagcacctcaacctgctcccccacgtcagggagccagtaatccttgttatcctgggtattgcgctgtagcacgttaagccagtttgtgcgcagattatcgcattcaggcagacgaacgcgggcctgaaccctgtcggcatcaacggcactgaccgtaccgatctgacgggtgacaccagtcattttttcttctccttaatcaccgtcgatgtactgccatccgggtgataaaccgtgagtttctgagttttttgttttttccctcttgtgactggcccccgtgccacttccagctctgtggtgtagccgctgttacgctcaaacgcatggcgggcagtgattatcagccatggaccggataactgtccaaagcccaccagttcaattttgttgcctgctgtcagttgaggcgttcccgtcagcgtcagggagccgttctgctggtattcgttatgtctggccagtgctgaatccgctttaatccgggcgctgtccgggtcgctgacgcggctgttaactttaagtgagtcagcgctggtaaccttaccgcctttgagctttttgtcgctttcacgggtaccaccatcagcttcgtagacgatcagttttttactgctgcttttctggtgttttacctttgcagatttatagacccggttgatggtgtcacgcagggaaaagcgggccacaccctgcggttttaactgcctgaccggctcctgactgcgcagtgtggccagatgagaaaaaatcaactggtcactgaccactttcactgcataaccatactcgctggccagccggcgcagaaaacccacgtcggtttcagcatactgggtcacccggtcgattttgatggactcaatgctgcccaccagtttcagtcggtgctttctggcaatccgccccgcaacagctgccagcgtggtgttctcaaaaccacggctggatttagtccgcagagcactgttaaccgaggtggccaccccacggatagcgacaacggacgcgggcgaactcacttcgatctcgtctattgagaatgtaccgcaggacagcagtttctcgccctgataacccattttcagcgtcagcgtgtcacccttgcccggataccacttatccagccagcgaccatcggtgtcatccagctccacctcaatggtatcggactcatttttgatgttatcgctccagaccacacgggtgacataaggcgcgatatcagaggtgatgtttttctgcagataccacagagtgaataccggcgtcagcacatcgctgacgctggttaacgctgatgtggcttgcgcagtactgtttatctcagccatggggcaatatcctcttctgtacgggcatcttcagcctcaataaccgggatcagtaacaacaacccggagggcagcaccggcgtaatggccacgtgcggattggctgcaataatccggggatagcccagcgggtcaccgtagtactgccatgccagcgaatcccagcgctctccgtcacgggtaatatgttcaagaaacatcacacactcctcgtcagtattctggcggccattgcacttaatcccggagacatgcggttgaatgctgtgccggcggcgttaagctgcccggaaacggtatccagagcacctgcaatatttcttttgtccacaccactcagcgccgactgcgcctgctgtacatacgtggctgcctcactggctgttctggccagactgatggcatcgggcatggattcagagagtgcattaaacgccggaacacttttccccagagctccggatatattacccagtccgctcatcagtcccggcacacgggtcagcgcgacaacggggttacctttcattttctgcgccacccgaacggcactgatagtggtctggagtacagactgcgcctgtttcgcatagttgacgccgttacggacgaactgcgccaccccggaaggcgatggaacagcacccgatacagctccggcaccgggaacctgcctgcgtattgccggcggttgcagaggatttttcgggtcaccggtgtattcccggagagacacggtggcactgacagccagcacgttaccggtgctgtctgtctgctcgctggttgcggtcacatcggtaatcacgaaccagccgcgatagtcaccgttgccgaagaccagcgccagtgcctgatgggccttcatggctgttcgcactctcgccagctccacgtcgggcacacaataatgctgatggaagactaggcttatctggatttcgtccagcctgtcgccgacaaactgcaggccgggtttaccctcgatgcgggcatgctccgcataatcgacgccgaacgtggcctcgaagccgtcccagtaggtaatcagttcaaactcaatatcacccagtacggcaaacatcagctgtactccttacgttgtttctgagccagcagacgctccagcattttttccagctcatgcaggctcatattcagggcaccagtcagcccggcaggcgctgcggtttccttaccattgaggaaaaactgaggattaaagctgaccttgataccgccagacgctccaccgccagttgcagttgcgccacggcctgaatatccggcagccatgatttccggcgacgggatacggggaacatccggtgtcatttcagcggccaggcgctgcccggccagtgcagcaagcggagtggtccgttgcaggccaatggcggcaccctgcgcgatattgtcaccaaagcccataaacacgcgactcggtgaatggatgcccagcttttcgctgaaccagtcactgatgctgtcacccattccggttacgctggttttgagtgacgcccatttgtttctgatgccatttatcaacccgtcaataagatgaccaccgaagtcggtgaatttcgccggcagatcaacgccgagatatttcagcgcagccgcaaaggctttataaagcagaccagccggagaccagttaaccagcagtttaccaattcccacgatgccgccgttaaaggcttcctgaatgtcagcccagcgctgtttaaaccagctactgactgcgccccagttgcggtagataaggtaagctgctgccgcgacggcggtgataacgagaccgatgggattcatcagcagcgcccggccaatccagagaacggcacgcccggcgctcataattccgcgaaccagcccccctgagagcacaccacccagtgttctggctcctctggcgacagcaccaaagcctgtcaccagccagcggagtttaccgccttcccccagtgcgagcgtcagacgaagccagttggcccgaagtaaaacagcatttttccagacgcttacaaagggggaaagaaggagattcagcccaagcttgagaccgatagtggccatcctgaaagcgagtaatgcgcccacaacctttatggtgctgctgacgagctgcggatttgccgctatccatttgccaacactgtccattaaaggaataaatgtttcacccaactggagcaaagccggacgcaaggattgcccgatgctgatagcagaatcattaaagccgatctgcattctgcgccagcgaccttcaagcgtatcattctgctttgcagcatccttatccagggtagaaattgcagccggagcattcatttcctgcttactggaaaggtatttatcccagccctgtcgcattgacagtaaatggttgacagtctgaatatcggtaaagacctcagccagaccaaatgactccatgagtttctgctgaccttcctgatcgcctcttgctcctgcagctttccattgctgcaagaacgctttgcctttactgtcgataaaacggttggcaatcatcagtgaagcttcgtactgcgaaaaaccctgagcgacgtaattctgcattgacccctggtaatccaccccggctttagcatatttctggatggtatctccgcggcccattgctgccagccagttggacatattggtgaccgcttcctctgcagagccactacctttaccgacctccagactggcaacaatctgggtaatcgcatcttttccataaataccacgagcagcgaaggctttagccataccgggtaatgcttttgccatatccttcagctcaaatgacccaagtttggctcctgttgccgcaataccaaacgcctgttcaagttctttcgcatcagtgattctgagtgcatcgctgaaggcataagtcattttggcaaggtcggtcatatcggctttggttgctgtagcggtctttccaagcatctctgcaaacgttgctgcccgttcgggggccataccatcagcaactaattgtccgactccccctaacagagactcctgcagttggttaaccttcagcgaggcttgtctgatagcctggccaattgcacgttcctgttttgcatccaggtctcctgtgacactgatatcccgcaactgtgattcaaacgaggcatattgtttaaccgaggccatgaccggtgcgcccagcgttctgccaatagcataggtttctgcaccctgaccatagagcgccaggcggttagccttcaacgcatcaccggtggctgatactgctgacagacggcgctgctgacgttcaatttgctccatggtgcggcttacccgcagcaactcgctgttgagatgctgcatccgggaagaacccagttgaccataacgttctgttgcccgggttaaggcattctggcgttcctgcagacggcgggaggtatcaccaagggaatcaagggcgcgtcgggtgccactgacggctgagcggaagctgctcccgacaatgccgccaataatgacgccgactgaaaattcactggccacggtggctatcctctgaaagcaaaaaaaacggaagggaagtgtctgaaacccatgcagaacagccgcgactggcggctgttaagtgatacgttgttactgattgtcgccgaactcgcttttgatttgctcttcagcctgctccagccacatctccagatcgtcagtatcgagggcatcaatctcccccggttgaaacctgaaccatctcgccagcaggccctgcgcctgcatcagtgtttttgtcgctcttgcccagcccagtgattttctgaaatcgtttctgcagctccatatagtcggcaagatccatgttatcgaggtcttccgggaggataccggtgctacgggcaatcagtggttcgtcccagtctgccgggtctttgttgattttgcgcacctgcttcaggtcttttactgtcaggcgtttcagttcaatctgttcaattctggtacctgcagcagtggtgaaaggataagacagcgtaaaagtatcggactgggtctgtgacatgatcatactcctttgtaaattcagagcagtatgtctggcggtggacgtgacggatattaaaggggattaagaagaaggggccggagcccctgtgatgtcagcaagtgcgaaaacccttgcagttacgcaggaaagcgatgagaagcgcctttccctcagatttgccggtgccggagaaccactggtcgggcggcttccatgcttcaatcaaatcggccagtttgcgggcctttgaacgtgtgcagtcaatcgggtcattggttttacgggtattaaagagggtctccacccccggaatatcaaggagggtaaaccacgtaccatttgacatgcccagtgacgcacatcgccctcctttgtcagtcagttcaacactcaccgtcagcccccgatattgattcgatagtcagtcagttgatcaacgccaccgacgcggaagatgttggccagatagtccagttgcagcaactcttcaccatccagtacctgtctgatatacgtgcaggtgaagctactggagaactcggcgttctcgtgctgtttgaacgtccccagcgggttcttcttgaacataattgtcaggaaggtgaccagcgggatttcgtcgatcagcccctgcgagctgtagcgctggacgctggagcgacactgcagcgccagcgacttgtacgggttcgcggcagacaacatcgcatcgcggtaaaagctgttccatttgatttcgccttccagtttgtcaaaaccagccgggagttccaccttacccaccatccccagtgccttgtgctcctgcataatcatggagacatcggggagtttaacttcctcagcccgtcccagcaggttagtaccatccagatagatgttggcattcgtgattcggtttatctcaatctttgacatcagttgccccctttcagggttaacaggtattccgaggtgatttcagtctcaaacgtcagtcgctccagcggcggtggtggcgtatatttgtagctcagcaacaggtgcccggcggccagctccgtctccggattgcgggccggatcaaaccagcaacggaagcccagtaccgcaccatcaccagtcattttgcgaccgtaggcgttgaccgactccgtcagtgcatcaatcagcgcctgagtaatcggcatgtcgatgtactgctggctgaagtaacgaatggactcgttgatcacatcaccggtgcggcgaacgttctcaaagttacgcatatgggtgaccgttggccatgctgccgtccggttaccccacagatgaaggccgctgccgtaactgctgaataccgtggtgatcccctgttcgttaagcaggttcacctcgctctgcggatcgtcaatcattgccgacagctggcgctccacgccggtgatccccagaatttcctgattggaggatgaccaccagtaccctttgtccaggtcgactttggcacgcaggcccgccgcacgctggctcagtggctccagacgctccgtgttcgtcaccgggtcatataccttcacatgcgggtagcacaggcggacacggtcagagctggtattaaagttaatggtgccttccgggccacgtcccgccagagcctgcgcaaaagtggtaccaaccggcgcatcaatataggttactgctcccagtttctcagccatggcgataagctcaaccgagacgctgttctgggtgcagaataccggagcaatcaggattttggcgaagtagccaaacaggttaaaactgtcgttaagcagcttcatgccggtacggttgcctgcagcgttaacggtaccgatgatatcagccggggtgactttggtcggatcagcatagttatagctggccttcaccgttgcatctgcagcaatgcttttacccaggttagtaatcaccccggtctgtgcatcaagcgagtagtcctgaccttcaacataaggctgaccgttgctgtccggtttcagtaccagctgcgcgaccaccggattagccagccgggctctgcctgtcgccttgtcgaacgacacattctcactgaccacagcgattttatgcacagacggatcgagtacgttaatgaccagaacggtgcctgcaccatggtcataaatcgcatccagcgcctgcggaatggtaaagccggtgaactggctgccaaatgccgcagcgtctttctcagacaggcactgtaccagcgtattgacatcccccatcggggcggtaccaatcaggccaataacggcagatttcaccgttttaaccgggcgggctccgttttccacctcaatggtttcgacgccatgcagatagttagctgccatgggagtcctccgttttcacttcgctgtcactgctgcttctgcgctttggtgactgcacagccggtgtgacggcgggtttagtatcttctggtaccggcgtcagatgcttcagcgccaccagtaccttcacgtagtcatgctcctccggcagggaaaccgtcttccccggccagagcaggatttcggttccgtccgacagcgtgacgccgctggccgggccggaatagcggtattctttcatcactcgctttcctcatagttcacttcggttaacagcgggccggacggtaaatcgctgtcttcgataaagacgctttcagtcgcgaagtcgagggcgtattgccacagccccctgacttcaccgataaacacctcgcgggtcagccagatacggcggcggcagccgggcggggtgtggccgccgagaatgcggcggacagcatccaggacattaatcgccccttttttaccgttgagctggcggaagaccaccgtgacgcagagctggatagtctgagactggatcaccgcaccggtatcatccggcctgtcaaagcgcgaaccggcatagctcagcagcaacgcgccaaccggatggttcaggcgatattcagccggtttctccgggaagtactccacctgcagttgcggcagcttctcgcgtaaccgggccagtaccgcatcaaggacgggcagaacgttcatcagtatttctccagtaaaccgtcacgaccgccgaaagtggccgggcggctgcgtacacgaaactcgccaggctcaggcacatctttctgagtggacggcagccccagcgtgagcctgttatcacgtaactccctgagttgccgcagcgcttctttgtggtcatccttcaccgtatccgggaggtcaccttccgggcggcgggcgtagagccggtaacggaccagcgtgatggcaatgtcccgcagaacagtcggtatctctgccagtggcaggatatagcgtccgcgcagatgggcatcaatcagctcgtcggcatagcggatacagctgtccaccacacgggtattcactgttgcaggcgagtcgaagtccatctcttcactggtgagctcgatcagcgttcgttccggcacctgcgcaagcaaatcctccagggtgcagtacatgtcacaccccgcgcaggatacgaatgacgtcgccttcacccccggcttcatcaagtgcaataccacaggatttaccgtcgccggactgcggcacggctctggcctgagcatctgactgaacagccacaccacggctgacagcggccccggcctcgacagcaataatgcccagaacgctcaccggcgtgctgtcgccggtaacagcatccacttcggcaaccccgagcgctgcggcaccggctttacagggggtattatctgccccgacaaaacgctgctgtgccagtgcggcccctgccgttacggttgtgatcagaatgacctgctgagtggttcccataacgcctccttatttactgataccggtaatgagatacccggcatcgccaccaaccacggcgactttgtagatatcggtataacggcagtacttcaccttgccgccggctccgtcgtacttgtcggcaacaggcatccccttacggcgcagggtgtagccgaaggacggctcgttctcgtccgcgctgtccgcccccggctgcggcttgccgacgtaatgcagcatcagattgtctccccagatatccgtcggcacgctgtccttatccattgccgctttcatggacggcagggagacaggagcaccgatgacgatctcttcgatctgaaagaggtcctgcaggatctccgtggtgatgcgcttgcgttcgttggctccgatggctgcctgaattgccgggtggaacttcagcagcgccatcacgccggcccccatggtcatcaggttaggacgcagccccgtggccgtacggaccgcttccataccggcttcaattaccccgatggggtcccccttaccaccggcccagcggtcgccggctgtcagttttttaacgtgcccggtacggtagaccttttcatcctgagccagacgggcggcgataagttcacggcgcagattcacgccattcgtggcgcgacggatggccttgctctcctcgttaaacatggactccgcctgttcgcgatagtccactggcgcagccagatcgtgctcacccagcaccagatcaagcgtgccggttttctcacggaccagaacattgctgtccgccccgacggcacgctcggtgtcatattccacaaaggcggttttcccgaaggtcggcacacgcacgccttccttgtccgtcagcacgacggggaaaatacgttcgccaatgaatgcggcatttttatagcctcgggcgatactggtcagtaccggatcaacgacacgtttaccttttaagtaatcagacatgctctctccttaaattacaggcagcgtgcgacagcagcctcatagctgatgccttcttttttggacagggccactgctttctgatgcagggccagacgctcaggatcggcttccgcaaactccgccacatccaccttcaccgcgtcgccgacacgatcctttgtggcctgttcggcgaagttcatcaccggctccccgtcggagagcaatgaacggaaggcggtggccagcggtgtgcggctttccccctcagcaaactccaccggcttgtcgccaccggcgacggcatccagcagggcaaccaccacggaggaggcgcggggagccagacgcccctctgcgaccagtttttctgcaaaggccacattgtccttatgcagttgctcctgtctgacctgtgcatcacgcgcatcgcgatcagcagcctgctgcttcaggcggcggttctcctcctgaagggcttcaatctcttcttttgtcatcgatgattcctcgttacttgcggaagacggccccgggcctgtctcactgaattgtgcacctgctgcatcctgcgacagtgtgtcgcggtacgcctcttcgcgcagactgttgagctgccattccggcaggactttttctgcctcgtccagactgaagcgggcgatcagaaaatcgcgcagctttccccacagggaggcattcgtgatggcctgccagtcggcgaactccaccacaccttcttcctgctcactgaaggacacctgtttcagccctttgacggaaggtggctgtgccccgagaaagcccacatggcgaaggtagagcacgccgggcttcggattggacggtgaatccgggaggtagaaagaggcggacacttttttgaatcgtccgtcggtgaccatctcagcaaactgcgggtccagctgggcaggctctgccatcagatcgacgccgctgagcgacagggctttcacccagccccacgccgggtcttccgttctgggatgaccaatcacgagtggtgcttcatggacggacgggtcataggctttcacgcaggcggcaagatcgtctggcgtgaacggcagttttttgccgtgcatatcggtatgagtaccggctttaaaaatgtgaatggctgacattttgctgtcccgcgttatgttgtcggagacagtttgtgagaaatgcaggcccggcgattttaatctgctttagaaaacatcaggggagaaggacagggaaagcaatgcggtgaaccggaggcggttataaaacagaggctgtaaagcctttataaaggtaatacagcccctcattcgctggcaatgataaatcacccacctgaagagagaaaactcagcgacgggccgctgattcaagatggcggacaatggtatcgaggatggggattaccacttcaggctgtagttctccatcccccgtcaccggcaggaacgggcgggccggaagttcaacagactcattacgccccgttttacccccgaactggtgaatggcaccgtaaacaacgttggtccccacaacagcctgccggtcgtcatggtcggttgatactgaccccatcagacgcccggtatcctgcagtgtctgcccgtcacgttcttccgctgccagcgagggcatccaccccggacgcccctcatcaagaaagttaaactgtgtttccgccagcagggttccggcgattttgcgcatcgcgggctccatgtctgtggcagccagatccagcgcacggaggctccggcgcagggatttatcgttaatggtgatactgaccaggttatcggaagccattgttatcctctcagttcctgttgtgccagtggctgaagcgtaccttgatagcgggccaggtcgggacggtatgctgcccccggtgcataagaccagccgacgtcggtggtcaccttcgtggtgccggtattaaaggtggccacgttccgcatttcgccggttttctctgagaccagtttcagttcctggcccatggcagagccggagctgataaccttcaggccacgggcacgtacatccgtcgcactcagggcaatcacactacagcggcagcgccagccgttcggcgggtaaaatgcctgccagaacgggtcatcccagcgcagcaccagaccatgcagcgccagatggctcctgcgggtatggctgtcgttgatgccggtatacatccagtacggcctgtcgtcgacgttttccatctgttccgcccaacgaccggcgctgtagagtacggacatattggtgcgaaagatggtatcgagccgccacggactgccctgctgaatggtgaccggcttacccgttaccgggtcagtcgtgtcacgtggtccccaccatcccttacgcttcagcaccggctccagctcctgccggaaccagcgatcggtttttccttcatcgacagcctgctgcagtgccccgcgaatatcttccaggatatccaggcgggtcactttagcaacggtaaaggcgcgggcatgggcctcctgccacatttcttcccagtcccaggtaatctgataccctttggacttcaggtaactgactgcccgcttcgggggaagcgtcatgcagtacgccagttcagccgttgtcacgctcatgcaggcgtccccagatatttgccacaaagagaatgcgggccagccgttcctgcagatcgtccgtgttcatctgagggtagagctccgccagttcgcccagcagctcagtcgggttaaccccgttttcgacccgcttaaacagaggtgccaggacgggttccagcgtgccatttaacacacctccgttcatcagaatgtccagcgcgtcgtcaagctgctgctgagcctgaatatcggcatcaatcgcctcggcaaatgacagcggcagcatgttattctggcgttccgacggtggtgtctcgtcaatatcgccgtcctgcagctggtactcacgcttaaagtattgcggggtcagacgcagacccgcccgggtgagtttttcgtcgcgggtggcgcgggtgtcatcaatggtctcctgttcccacatggcccagaccggacacggcacatcgccgaagttcagggtgaccaccgttctgataacctgattcactgctgcctgaatgatgtccgcatccgcatcgcggatatcagccgttacctccagcccggcctgtgctgaggccttgttactgttcgcttccgtggtctgattctgaccaagtaatgcaatggagatctcactgcgtgacagtgtgatcagctcgcggaatacctcgctgctgtccgccttaccatccgcggctttgagttcgatgctgctgtcatcggggatggcggccaccgcgtcctccaccatctgctccatggagtccagcagtttttcaatctctgcatcatttgcacccctcgggtgcttaccgatcacccacggggagccaaacttttcggcaaagcggagccagaatttcatcccgcctttcttgaaggcgaccggccagaagcacatggacaggtccgggaaaccgtaaggattgtcatacgaggcatcctgtgccggcaccacgaattttgacggtgacagcagctcaccctccacacccgcatcacgcgcccggaagcgcaggcagttgtccgtatcaaactgaaaccactcaggcggtttgccgacaatatccgtcactgcccacgccctgaccgaacggccccacatgatttcacagggctgatacccgtagagcacggcatcactcatctcaccgatgatgcgggacagatccagatcgtcgagcatgtcgcggatgaaacggaagacccgggcagaagcgtgaccgcgctccagtccacgctccagtgatttgagcgctgctttacgtctgcggatacagcccccaaccagcgggtcggtgcgcagttcgcggtagatacggatatcccgtccctgagccttgagaatgggatcaggattgggcagatacatgcccagtccgtaaaagtcgatcgcgcggctgcgggaggcaatctgcgcggtcagtgatttctgaggctcagaaaaagcaacaaattcatcgggtgaaacccagatacccctcgccatcagaatccctccagcatacgggccgcctgacgacgacagcgtgagcttgccttcaccggccctttgttaatttcacggctggcgaaatacgccagcgccagtgcgatggctgaatccccgtggcgtttaccaccgtcagcctttgcttttgagcgttgctccggcacgcgggggacaccgttcaccacctgaacggcccgcaggtcatccagtgtgtcttcatcctttggtaagtccaccaggttaccgtcttccagtgcagctttgaccggaggcatatgctcccggtaccagccttcagttggcatcacctgctgaacccggctggagccgtagcgctgcatggcgtattcagccagataggcaccattaccacgggcatcaaacgctgcacccagcagaccgggcaggccatccatcagataccaggtgatttgctcctgctgtctgaacggcacgttacgcagctccagtacgaatggcacgcgtcgtaccaggttcttctcctgcagcaggggatagtccaccgacaaatcaccgctacggccaaagtcgcgccccaggaaagagcgggcatcagcggggagtgcctccagcaagggtttcagatgctcatcaagccagtcctgtgtctcgtggaagcgaacctcatcagacagcagttcataaccttcctgacaggtcagacgcaataccggcgtatcagcggacatgcgggactctatcagggcacgggacagccaggcgccgccaccgttggccggaatacagtcaagctcttcggatgcgccggcagcgtagaatttgtacaccgacgccatccaggcctgctcggatgcctctgaccattccttcccggtgcgcagacaaacgcgccggaacagcccctcagatacggcttcccggaaagtgatgcgatgtacgctgcctccctgacgtccggcacggatatccccgataagcgtattgaacggattgtcgtcaccgtcatgggtggagataacgcgtacctttcccccccagataagcatcgccagcgccgctttcagcagttcgtccagttgctcatggaacgccgcttcgtcgataacaataataccctgacggccacgcaggttagacgggcggctggagagcgcaacaatacgaaagccggagtcaggaaatttgatggtgtaagtcttgatgtgtttgtcgtcgtcgtcctcttcccagaatccttcttcaatttcactggccgcatagttgaatgcccgtgcccacattgcacacgcctgaatgtattcgacggtcatgtcctggttataagcgatgtaatacacattcatcccgcctgctggcgcagaagaggcggcggtcagtacgttatcggatgcctcagcccatgtaataccggtacgacggctcttttctatcaccttaagcggagaggtgtctgccacccagcgctgctggtaaggcaacagaacgggaggggcatccagcgccgaggtatcaggcaaaacgggagcaaggttattcctcccgtccatgggactcatcccttcggggccgccgccagcggcgtttaaaatcactccggatgattttgtcatgtggcaatccccagaatctcgcgacgaagcgcctgtactgcgtcgcttgacagtccccccttacgggcaattttctcggcgttgctggctgcctgctgcgctctggcccgtacttcagactggaactttttgaggttgacggacgcgcgggacagcgtagccacattcttcgccaccttcgacagcagggccacgcgttctttaggatcgacttcgccttcttccgcctcctgcaactggacaatactctcgaacagctcggtctgaataagggctatcacagcctccgaacgcgcatcctgatcgtctgctgcgccttcggtcagcatgcgggccgcttctgttgccgcacggatagcaccatagcggcgctcaatcttctgtccatagcgatggatagcggatttgctgataacgtacccccgctcacgcagcagggactccagctcgttatacccgctgaagccggattcagtcagcgcccgttcaagccagcggcgcacgtcttccggcagcttttctattgtgctgcgtctggccattattcactccagtacttttccgggcgggcaatacccggaccacatttcacggtgtattccaccaggtctacgccgaggcgggtcaggtcagcaaaccagtcgccagaaggttttttctccagatcaaccattttacggtcagccagataatccagttcgcggcgcagttccagcggtgtggtgtccgggtagatggcacgggacacatccagcagcagcgtctcgctggcggtgtaagggcgggtcttgttcagggcaaccagcagactccagcgcagggattcgcggcgtacccgggtaatatcgaccattattgacctccggtattgcggtactgctgtaccacttccagtttgttataaagcgcgtccagtttggcctcaatgactgtctggccacggatataatcctctcgacggacataattcagcggtaaatccgctttaaatcgcataaattctttttccagctcgccccagttggaggcggattgttgcagggcctgttcaagggaggcgaatcgtgccgcctggcgttcttctgttttactgaacaaccatttggcgagccctcccacaaaccccatgaaggtgagcagaaaactcactaccgtccagaattcaacctgcagtgtcatttctgtaatccttcccgttcatccagtaacgcgtttatctggttccgccagcgacgacattgtcctgcgttgtcgatgatgttggcgagaacgtcacgctgggagacacccgaatcgcgtaaccgggtgtcagtggtttcaggttgcccggtcgctgtgccagagcgggtgccagcggcggcaactgagtctgaatgaccggtgtcgacggatgcattgtcatatccgagtgcggcgttgtactggcgcacgaaaccgcgagtaaacacgcactcaatgggatggctcttacctttttcatcaatccagcgctgtgtgacatcgttaatttgcccctgtagttgtttattccggctctccagttgagcaatctgctcaagataaccggcttcagcccgctgcccggcggccacctgctcctgataccgtctggcccaggcccgcagcgcagcattctcaagcgttgcctgctccgttttgtacgcgtcaaatgctgactgcaactgactgagcgcggtatcaccgtcacgctttgcagagtcatgaccacttctgtatcccatggcatacaggccgaccagaaaggcattgataagaatggccagcagaatgccgcgccacggcagctttttaaccagatgccacacaactgcagcctccccatgtgagatatcgcggtgccagttcgcgcaggatgcgctgcggataatggcggttctcccgccagctggccgcattgcgtccggcattcaccgtggcgacatgtccgaaccagcgggtgctgtccagacctttctgtgatgcaagccgcctgtcccgttgtacccagcccagaccaccgttatagcccgacaatgtcatggccatacgctcgcagtcgttggcggcgctgacgcgctgccacagccagcggtcatagctgaccagcgcccggatagcccatgcaggattaaacggctcacgattgctcagcatcggtatcaactggcttatccagtcggcagtggcaggcatgaactgcgccagtccctgagcgccagccggcgagaccacatcaggtcgccagccgctttcctgatgcagttgcgcggcgaaatcggccaccggcgcagacagtccccattcaagccgggcattacggatcacatcatcgcgatactgcagcgcagcctgcggaggctgcgctgcgcgggcctgactgaagaagccgccacaccagagcagccagacaatcaccaggttgccagcaagctgccaccagaagctgtatttatcgttacgtggttctccgtgtctgatggcggttacgcccagaccaaaggcgaacagaataatgagggtgatttgaggccagttcatggtcacagtcctgttgccacagccagacagaccgctgcaacaatcagtgcacggcggattaacgcagcagaaaatacaaggtgaaggccggtctgcacagggaaacgcccttcagccatcagtctgtcgtcatgtttcaggtactgaccgggacgggctttggggaagagcgaacggtcaagccagtaacccagcactgctgccagcgtgatgagtgccagcttgtagatcacaacaggcaactgctgtggcgagaccagagcgatgatgcccagcaacagcactgaggtcagcagccagccgctgaggcgaggttttttaacagggggaatgaattttttcaggtttttcatgtgtgtctcctcgtttggtggagacagcatcacaaatgtggcgggatacggattttaaacagcgttaatagtgaagatgtaaacgtgcactgcatgatggctttgaaagaacgaccagcccggtacccgaacaccgggctggccatcgccccacaggaatgcgctgtgagccgacacgaaacccctcttggaattccatacgacgatacagagctgtcagcatctcaaatgaaatcgccacgattaaacctcagtcatccacatttccctaaattcttcaggtacattacgtagggtgataatatttgtttccggatcataatcaatatagccttcagttttcccttcccggtcaaacttaagttcccaatatttagacttgcctttaaaagataccagagcccgaatgactcgaccatcaggaacgaagccatccgataactccaactcttcagcagcaagtttaccagataactcctcgggagcctggggccaaatggcattaacaagggtttcaagactaagtggttcaccagccttacttagtgcatgtaagtgttcaaacgcactcttaagaaatgcatctttttcagcgccgtcaagtcctttctctgccgcaaatgcttttaaaacgtcacgtaacttttcagactctcgtttggcgattaagacatcattacagcctaggaactgtgtgcgtcctgcatattttgcacaaatatcgtttataaggcgctgagaggcttcagtaactagaccttcttcaggactcaatctctcagaagcgtctccatttgaaagtgagttggggctggcataccggacatctgtgagaatgatgcaagcatcgacaaaatacttatccccggcgctgaaaccaaatgtgccaacgttggcacatttgggaaaagccaaacttttcgaattaatgacagaagacgacgaagagcttgccgaactggccgacggcggcacagttgccggcctgacgcttgacgacgttgatcgcatgtcagtacgcgaacttcgccaggccctgcgcgaagcgcgcgaaaccaacgcagcacaacagcgcgtactcgccgataaaaatgaaaaaattgattctctctctaccagactggaaaagaaatcccgtattcagccgcctgagcctgatgaggaggttaagaagctgcgggcggaagtgacagcattagcggttgaggcggaatctgctatcgccgttcgactgtccagcgcttttgagacactgtgcgcatattgagctgaaaacatgattgatacccccagagacttcatggcaggcctggtctgtcaactggaaagcacagcgcgtagcctgcgctccacatttgacctgccggacgagccaacaggcaatgcagcgccttcatggctgactgagccgacgccacagattaacgggctggaggcataaccaatgaatgctgccctgactgaacgactggtttatgtcgcccgcgcggcacgtgacgcggggcatggtaaacgcggtgcaatatacgacgctgcctgtgctgaacttggcatgtcccgcgccactctgctgcgcaggctgaaggaggtctctgtgactgataaacgcaaaaaacgcgccgatgccgggcgcagcgccctgacccgcgacgaagccgcgctgatatctgccacactgcgtgaggccacccgcaagaacggtaagcgtctctattccatcgcggatgcagtggaaaccctgcgggctaacggctttatctccgcaggcagaacagatgaaaccaccggtgagtttttcccgttgtccgaagatgccatcagccgtgccctgcgtaactatggcctgcacccggaacaactggatgcccctgcaccatatactgaagtggccagtctgcatcccaatcatgtctggcagattgatgcctcgctctgcacgctttactacctgagcaatggacataaagggctgcaggtgatggacagcgcgaagttctacaagaacaagcccgctaaccttgcccgtatcgccagtgaccgcgtgtggagttacgagattaccgaccatgccagcggctggatttacgttgagtatgtgacgggggcggaatccggtgagaacctgtgttctgtgcttatcaacgccatgcaggagcgtggcggcgcagacgtgttgcacggtgtgccgaaaatactctatctcgaccccggctcggcaaacaccgcgggtatgacgaaaaacatgtgtcgctcactgggcattgacctgatagcgcacaagccgcataacgcccgcgccaccggacaggtggaaaaggcgcgtgacattatcgaacgcaagctggagccgggtctgaagttccggccggttcacagtctggaagaactcaacgcgctggccgcgaaatggcgcagccactttaacgccacggctgttcacagccgccacggtaaaacccgcacggatatctggctgaagattactgctgagcagctgaaaaaagcgccttccgttgaggtatgtcgtgaactggctgtggcggcaccagaactccgcaaagtcacgccaaaacttcgtgtctcgttccggggcactgaatttgacgtatcaacggtaccgggcgtactggtcggtgaaaaactgatgattacccgtaacccgtggcgcagcgatgtggcacaggtggttctgaccggtgaggacggccacgagacgttcttcctggtcgaagaggtcagaaagaacgagtttggctttgctgaaggcgcggcggtatttggcgaaagttacaaagccctgccggaaaccccggcgcagatggcggcaaaagaaaccgaagcgctggtcaccggtacagacaacgccgcagatgcagctgccgcacgcaaggcgaaggcgctgccgttcggcgggcggcttgacccgtataaacatattgatgacgccacacttccggcctgtataccgaagcgaggtcaggcctctgacgtacgcggaccgcgcactgaacagcgtcccatgactcatgtggaggccgcgaaagccctgcgcgggaagttcagcgccaacggccttacctggacgccggaacattaccgccagttaacggcacagtatccggacggcgtaccggaagccgcactggatgaagtcatggctacgctgaccacgccggcccgcagcagcgttatcagcattgttaacggcaactgaggagggaaacatgctggtactgaagcagcaactgaaagaggcccgtattccacaggcggtggtggcgagagctgtcgatgtttctgaggccacgctggcccagattgtgaatcataacgcgtggccccgcaccagccccggagaagtgcgccggcgtcttgcgtcctggctggaaagtcaggggattgatacagcgaagagttttgatgctgtacagggcgcggccacgccccgtacagcgggtaccacagataaaacgagcctcagtgaggaagagaatatgttactcaaaaaacaggtgttatttccagcaaccaaaaaagcgtttggtcttttccgtgacccgttcgccgacgaagccatgcagggttctgatgatgtgttcaccacaccagacattcgctacgtgcgtgaggcgttgtaccagacagcccgtcatggtgggtttatggccgtcatcggtgagtccggtgcgggtaaatccacgctgcgccgtgacctgactgaacgtatcaaccgcgagaatgcgccagtgattgttatcgagccatacatcatcgctatggaagacaacgatgtgaaagggaaaactctgaaggcagcagcgattgccgaagccattatcagtaccatcgcaccactggaaagcatcagacgcagtcaggacgcccgctttcgccagttgcatcgcgtcctgaaagacagcaaccaggcggggttcagccacgttctggtgattgaggaggctcacagtttgcccattccgacactgaaacacctcaaacgcttttttgagctggagtccggtttcaaaaagctgctgtccatcgtgctgattggccagccggaactggcgacaaaactctctgaacgcaacatggaagtccgcgaagtcgttcagcgctgtgaggtggtcgaacttctgcctctggacaatcaccttgaagaatttctgacgttcaaactgcaacgggccggtaaacaactgacggacattatggacgccagcgcagtggatgccatacgtacccgcctgagcaatccgggaagtcatcgtaaaaatatggtcagcctgctgtatccgctggccgtcagtaacctggtaatagccgccatgaatctggccgctgaaatcggggttccacaggtcaacgctgacgttgtcaaaggggtttaataatgaaatccaccacaggtatcaaccagcaaatcagtaaagtgcagtcagccattatggcgcttaaggcgacgaacacggatgtacaaagcatcaccatcaggggtaacaaacctgtcatccgcgtttccaggagtgcgcattgcatgcgcatgcttgagcagggaaaggcctgttatctgtataccggacatgaccacaggggatatttccgtcagggcgttttcgaactgcacggctgtcgcgtcgtgtggccggaatctttgtggtaatcagcacaactggagaaatcataaaaaatggcaaaaagtacaaaaggtgcaaaacgtatcaaggccgcagcagcactctgggtgccggggacacgtgaagaggtcattgagggcatcagactgctcggtgacgcacaccgtgaactggtcagggctgaaacagaaatgaatgacgccattggcgatatcaccgcacgttatgccccgctcaccgagagcctgaaaaaacgcatggccgaactgcagtccggtattcagacatggtgtgaggcacaccgtgatgaactgaccggcaacgggaaggtgaagtttgctaacctcaccaccggcgaggtgcagtggcgaaaccgcccgccgtcagtcagcattcgcggagcggataatgttattgaactactgagacgtctggggcttgagcgctttattcgtgtaaaagaggaaataaataaagacgctatcctgaatgaaaaagaggccgtgaaaaatattcccggtatttccattaaaagcgacattgaggatttttcaataattccttttgagcaggatgtgcagtaaacacaccacgttaattatttaataaaaacattttcttttttattccggcgtcagcgccgtgggcttctgcacgctggaaacagaggagaattaaattatgatatttaaatgtattcagtgcgagagggatataacagccctgcgttttcacagcgccatcgccgtgatgtccggtaaataccacatccctgcggtacgcgtcaccctggtctgcccgtactgcagccagcatttttcggcagacgtgcctgtcatggaattctcccgccctgacagggaggacgcgcaatgattaccccacaggaagcacgccagcgtacccgcgcccttgttgaacactatgtcaacgagtgtgaatgccgcgacctcaccgatgtgaagcacgtcctgacggcgctaatcagcatggccacgcaggccattgtggcgaccaacggaaaggcggctgcactgcaggtactggtgaacacactcacccacacggcagagaacgaggtgccgtaccggatggaaaccactgcagaaggcggcctgcacatcaccgtcagccggaagcactgagggcgcggcatgacacggaacaccgaactcacccgcaccgccctctaccgtctggccctgcagcgtttcgggccggacgcacaggccctgaaactgacagaagaggccgctgaactggcggccagtgccgcccgcaacctgaacggacagggcagcgaaagtgacctcgcggcagagctggcagacgtggaaatcatgacagagcagctgcgccttcagggaatggaccggctgattgacttccacaaacagaaaaaactggaacgccttgccgcacggctgggcgtcacatacaccggagaaatcatatgaaccgcaccgaacagacgccacaactgacgccggaagatgctgcacagcgtattcgggtactggaagacgaaaacgaatacctgcgcaagagatttgaagaggtggacctgtacttcgggcgcaatctggtcgtcatgaaagctgcagtgattgagtggcgggccaccggtgatgccaggaacggcatggcgtggatttacaacaccctgtgtgggccgggcgaactgccgccgcaagaggagaaagaggcacaggaatacttcaacagggaaactgaagttatcgacagaaaactggctgccctgtaccactggttcaggaaataccacaggacacacgccgcacctgaccagaccaccacaggaggtaccagtgactgacaccattatggaaattgtggtatgggctttcctgcttactggtatagccgtgtgcatctgcgccggattcgccctggttgccctgctgacccacgtggtgacgcagtggttatgggaaaagcttaaagcagcatacagcctgaaagagctgtccgacgctgttcgggcatgggaacagcaaaaaaataccggagatactgaacaatgacagaccaggataagcacattgagaaactgaaaaagttgctggcgctggcagcatccggcaacccgcatgaggctgctctggcactgcgccgcgcccgtaaactgatggatgttcacggcatcacacattccgacatcgccatgagtgatattgatgaaaccatcagtcactactggccgacaggcagcctccgtccgccgcgctacatgctgggcctgatgaacatcatccgcgaggcatttggtgttaactccatcattcaccccggcacatatccgggtgtggggttctacggcaaccgggaacgggccgcactggccgcgtacacctgggaagtgctggcccgtcagctgaaaaaggcgcgtcagcagtatatcagtgcacagaacaaaagaataaaaaccgccacccgcaccagccgtggagaccagtttgctgaaggctgggtgctggccgttatcagtgaaatacagtccttcgccctgaccgatgacgaacgtgaactgatgcagcagtggctggaacataaatacccgcagacgcaaaccaccagggcgcgtaaaccgggaagaagtcgcaatggcgacgcctcgcgctatgcggggtttcgagaagggcagaacgtcagactgcaccgaccggtcagtgggcgggaacagcagaaactggaggccagatgattacgttatcaggtaacagccggaaattaaaagcctgccgaatatctgccagatacctttttgcccgcgccttttttaagaacgtcaggccggggatcacaattggtgttattgccggacgcgaacaggttgaaaaatacatgtcaggtgcatggtggaataaagaccctgtcattgctgcccgtaatattcatatcagttggggggatattcagaatgacgactgaatctgttgtatgtgccctgttctggtattgttttgtcggttggtgtactgctgaactgcaccgccgttcagggttttattcacgttacagtggtgccggttactggattagctggtcggtgatgttcctgtgctggcctgtggcacttcctttatatgtcgattatatcggtgatgcaggcagaaggagcaacaatgatgactaaacaacgtcttatccagctcattcatattgcccgtaatgaactgggtatggatgaagacacctaccgccagatgttacaggggctgaccggtaaagcctcaaccaaaggaatggataccacacaactaaactgcgtgctggaatccatgaaaaggaaaggctttcgcgttaggcctgcaggaaaagccagctccggtttaccgctggataaccatccgcaatccaggaaaatccgtgcgctatggcttgaaatggctgctgccggcattgttcgtgaccgttcagaaaatgcattagcgcggtggatcaagcgggaaacgggcatcagcgccctgcgctggctcaatactgaacaggcaagcagtgttattgagaaactgaagaagtggcagcgcagagctgcgggagtaaaacatgagcgacctgaatcagtttcgaagtaaagggccggaactcctggtggaactggcacagcatacctctgagaccgttcgcgagattattgatattgagcccgcaattgccgaccagattggtcaggccgtcgcgaaccgcatgatgcaggtctggggcgggcaaaacgtttatttcccgatgggcatggtatggaaggtcagtcagcgcgaccgggaaatcttcagggagtttaacggacgtaaccaccatgaactggcccgcaaatttggtgtttcgcttcagtgggtctacagcgtggttaagcgggtaagaaaagaagaactggatcggatgcagggcaagctatttgctgatgaacccgatgtagatacggagaaaaaagagtaatatctgcaatcaggctggcgcgagttctgtttttgttcgggccggtctgattttcacatactgtaaggttattgcatattcctcctggtctcttcccattttgacccagttcttcccataaatatctcacttattccctgtcatttatctcaagtctaatcacctgatggcgacgcgcgccttatttatagaggtcggcgctgatggtgatgttattaccgcgctcctgccactgacgcgtaatatgataatacttagcgcctttcttcgccgcgcgtttggcgacctggtaggagatttctgtcatattgccgtagttgccggtgaacttaacgctgtcgaaaggcaccatcatcgcagccgtcgctttattcagctcctcaacttttgtgccatccggaagtgtgacagtgtaacgcccgcctttggaggattgcgtttcgaagaaacggcctacttcggcgctcggcgaggctgacgtggcgacgcctggaatttcgactttcttcgcagcttcgccgccctgagccagcgcggcacggccagcttcagagtctgccggaatagcgtccgggctctggacgatgcgttttttcgcatcttgtttatagataaatacagtgatgcgttggtttccgccctgattcgcatctatctgacgaacaatatagaaagcgtatgcgcctttttgtttcgccgctttcgtaatggcatcgttaacttccggctggctacggtagaagccctgaacggtgacggtgtcatacggttctaattgtacggcctggtctttcggtaattccacgatgccattaatgacacgatttttgggcgcgtcggctttcggcgcgtcggctttatacacgtccgccacaacacgccagttaccactgttgccgaactccgaggtgtcgacaacatagaaggaggctgcgccttctttatctgcgcggcgggacacggcggagaccgcatcgccaatagcattaaaacgaccggtaataacgatgcggtcataaggttttagtgcagccgcttgctccggcgtcagttctgttgctgcatggacagaaaaagcagccgcagaaagcagagccgacgccaggagagtgttcttaagcttcataaaaataatcctttgccttgcgcaaaccaggtactggtattgttattgactagaaacgtggctgattattgcatttaaaccatatggatgtctgcgggatttttcacgcatcgtgtcatgtatcctatctttgatgataacatttactgatatgtcgaaaaaaacggcgtccgggcggctaagctaatgaagcgcataaatttaataagttaatttaatgttaatttcttgatctcgccaggggtttaatgatgttttgctgtcaaatttgagcgaattatcagccctcgcaggccattttcaaggcattatggctgcttagcggctgaatcgttcatgttttgtaaatttgataaaaaattctgttttttggcgctagatcacaggcgttattttcagtaggttatagagagtttgtaacggttttattctgctggggtaacatttacctcaaacgcgggcaggcgtacgcttctcgcgcttactgacaaaccatcatcaaaaataccgatggaagggaacatttatgcgaattggcataccaaaagagcggttacccaatgaaacccgtgtcgctgcgacgccgaaaacggtagagcagctactgaagctggggtttagcgtcgctatcgaaagcggggcgggtcaactggcaagttttgacgacaaagcgtttgcgcaggctggcgcggatattgtagacggcaatgctatctggcaatcggaaattattctcaaggttaatgcgcctgaagaagaggaaatcgctttactgaaccccgggactacgctggtcagttttatctggcctgcgcaaaatcctgggttaatggagaaacttgccgaacgtaaggttacggtgatggcgatggactccgtgccgcgtatttcccgcgcgcagtcgctcgacgcgttaagctcaatggcgaatatcgcgggttatcgcgccattgtagaggccgcgcatgaatttgggcgcttctttaccgggcaaatcactgccgccgggaaagtgccgccggcgaaggtgatggtgattggcgcgggcgttgccggtcttgcggctatcggcgcggcaaacagcctgggggcgattgtccgcgcgtttgacactcgtcctgaagtcaaagagcaggtccagagtatgggggctgagttcctcgaactggattttaaagaggaagccggtagcggcgatggttacgccaaagtgatgtccgaggcgtttatcaaagcggaaatggcgctctttgccgcccaggccaaagaagtcgatatcattgttaccaccgcgttgattccgggcaaacctgcgccgaagctgattacccgcgatatggtcgattctatgaaggccggcagcgtgattgtcgacctggccgcgcagaacggcggtaactgcgaatataccgtcgccaatcaggttgtgacgacggacaatggcgtaaaagtgattggctacaccgatctaccggggcgtttgccgacgcagtcatcccagctttatggcaccaacctggttaacctgctgaagctgctgtgcaaagagaaagacggcaatattgacgtggattttgacgatgtcgtgatccgtggcgtgacggtgattcgtgacggcgacattacctggcctgcgccgccaatccaggtttccgcgcagccacaggccgcgcctaaagcagcacctgcgccaaaagagccggaaaagcccgcttccccctggcggaagtatgcgttaatggcgctggcgatcattctttttggctggctggccgatgtcgcgccaaaagagttcctcggccattttaccgtgtttgcgctcgcctgcgtggttggttattacgtggtgtggaacgtgtctcatgcgcttcatacgccattaatgtcggtgaccaacgcaatttcagggattattgttgtcggggcattattgcaaattggtcagggcggctgggtcagcttcctgagctttatcgcggtgcttatcgccagcattaatattttcggtggcttcaccgtgactcagcgtatgctgaaaatgttccggaaaaactaaggggtaacacatgtctggaggattagttacagctgcatacattgttgccgcgatcctgtttattttcagtcttgccgggctttcaaagcatgaaacgtcccgccaggggaataacttcggtattgccgggatggcgatcgcgttgctggcgaccattttcgggccggataccggcaacgtggcatggattctggtcgccatgattattggcggcgcgattggcatccgcatggcgaaaaaagttgagatgaccgagatgccggagctggtcgcgattctgcacagtttcgtgggcctggcggcggtactggttggctttaacagctatctgtaccatgacgccagtctggcgccggtgctggtgaatatccatctgaccgaagtcttcctcggtatctttattggcgcagtcactttcactggatcgatcgtagcgtttggtaaactgcgcggcaaaatctcttctaagccgttgatgttgcctaaccgtcacaaaatgaatctggcggcgctggttgtttctttcctgttgctgctggtttttgttcgtaccgaaagcgtgggtctacaggttctggcgctactgctgatgaccattatcgcgctggcgtttggttggcatctggtcgcttctatcggcggggcggacatgccggtggttgtttcaatgctgaactcctattccggttgggctgccgcggcggctggcttcatgttgagcaacgatttgctgattgtgaccggcgcgctggtcggttcgtcaggcgcgatcctgtcttacattatgtgtaaagcgatgaaccgctctttcatcagcgttattgctggtgggttcggtactgacggctcctcaacgggcgacgatcaggaagctggcgaacatcgcgaaattacggcggaagagaccgctgagatgctgaaaaactcccactccgtcattattacgccggggtacgggatggcggtagcgcaggcgcagtatccggtggcggaaatcaccgaaaaactgcgtgcgcgcggtatcaacgtgcgtttcggcattcatccggtggcgggtcgcctgccggggcatatgaacgtgctgttggcggaggcgaaagtgccttatgacatcgtgctggaaatggacgaaatcaatgatgatttcgccgataccgataccgtgctggtgattggcgcgaacgatacggtgaacccggcggcgcaagacgatccccgcagcccgatcgccggtatgccggttctcgaagtgtggaaagcacagaatgtcgtggtctttaagcgttccatgaatactggttatgctggtgtgcagaacccgctgttctttaaagagaatacgcaaatgctgtttggcgatgccaaagccagcgtggatgcaattctgaaagcgctttaatcttttaaacgtgcggcggcctctttggaggccgtttttatacatttcaccctataagctgcctctttgttggctgcgctcagaaaccccggtcacatcgttatctatgctcccggggatttcttcccttgccgccgcgatgcatcttgaatgattttgtgtatatattgcattttatcttttgtttaaatcgctaagcagaacggcgatactctgcccgccggtggtctgttcgagggcgattttgacaatgatggttaacggaacggagagcaacatgcccaccggacctaatagccagccccagaaaattaacgacaaaaataccactaaggttgaaaggcctaaaccacgtcccatgatacgtggctcaaggatattgccgaagaccagattaatcagcagatagcccgccagcaccagcagcgcatcataaaacccgttaaataccagcacctgaataatgggcggcagggcagcgagcaccgatccaatattagggatatagttcagcgcgaaggccagtagaccccagacaaaggcgaagcggacatccagagcggccagcattccccatgcgaccagtcccgtcacgatactgatcgctgtttttagcaccagataatgtgaaacgctatcaagcgcgcgttgaattgccgccataccttctaccggacggctcatcatctgctgcagtttttcaggcagttgtggaacctccagcagcatgaataccacggtcaataacaataaaaagatggatgacatggcattggacagttgggtgagcaggttcgttaccagagtcatggcggcgtttggatcgatatatttcgccagctcatcaaccgacacgccaatgcctgctcgctgcaaccacggttcaatacgttgcaacggtatcaccaatgaggagcgatactgcggtagggtacgggccagttcatttaatgatgtccccaaataggccagtagcagtaccattaacataacaataatcacaatgagcaatgatacggcgataacgcgcggaattcgacatcgggtcatccgttgcacaacgggattgagaacgactgcaataaataacgccaaaataaagggaacaatgatatctgcggcgaagcggataccgctcagaataaccaccagcattcccagcataatgacgatttttagaccattgagcgtgatgatcggttttgccatatcagtccctgttttctatgccgacacgaataataatgtgatgtcggtcgacctgttctggttaaaatcaaacacttcaggtaaagaagtgaaaatattttgagttaattcctggcttatgatacaaatcaggcgtgttcaactaccgaggacaattatcatccgcgatgacgagaagcaacactgcggataattgtaatattatggacaatatgttcagcgcttttttctccacgcaaacgcatcttcactctacctcctttttcctgcttatcggcgagcagcactggcgtaacgcactttagtctctcacttctgcctgagctggcgcaatgcgctgtgctaactgattttattttttagtttgctgcgtgcagcagactcgaaagagtatattctcatgcaggagaagtgtcatgttttactggattttattagctctggctatcgcgactgaaattaccggcacgctctcaatgaaatgggctagcgtgggtaatggcaatgcgggttttattttaatgctggtgatgatcacgctgtcatatatatttctttcttttgcggtaaaaaagattgccctgggtgtagcgtatgccttatgggaagggatcggcattttatttattaccatttttagcgtgctgctatttgatgaagcattatcaaccatgaagattgccggcttgctgacgctggtcgccggcatcgtattgatcaaatcagggacgcgtaaacccggcaaaccggtgaaggaggcgactcgtgcaacaatttgaatggatacacggcgcctggcttgggctggcaataatgctggaaatcgcggctaacgttctgttgaaattttcggacggctttcgccgtaaatgctatggcatcttatcgcttgccgctgttctggccgccttcagcgcgctttcccaggcggtaaaagggatagacctgtcggtggcgtatgcgctatggggcggttttggtattgccgccacgctggcggcgggctgggtgctcttcggccagcgcttaaatcccaaaggctgggttggcgtgatattgctgctcgccggaatggtcatgataaaatttgcctgagacgatcgctgccggtcaggcagcgattcccgcattaatcctgcgccagagctttcagcttatcgcgaaagccggtgacggatatagcgcggttatcggcgcgccagcgatctttagccgcaggggcggagctttgtacgccaatgagctgccatccgctatccgtgtgcaataataacggcgagccgctgtcgccaggtaacgtgtcgcactggtgtgagagtacggcattctgcgcccagccggtcacgacgcaatcctgatgggaatagagcgcattcagatgatcttccggataaccggactgcgtgacttttcggtctgcggctttcaacgccgcagtgagcgccgctttatcgccggtaaataaaggtactggcgtgataccggaaggtgggtagcgcaatattaccagaccaaaatcccagcttgccgcggcaggcggcacaatccagccatcgccatccgctttcaaacgtcggcccagcgacggttcaacgcggccttcaatgccgtggatttcatagcgccatactccttttcgcgccacaaaacgcagcgcaaccgctttgtccggttttcctttcggcggcgttagcaggcagtgacctgctgtcagggcgatatgcggggagataagcgttgccgtacacaaattaccgctggcggtctctagttgcccgatggcatcccacggcgattgggttggatcggcgacgggcactcgatcgtcatggttaaaaaaaagcgttttgacgtcgctggcatccgtggcgtctgtttcagcccccccggctttcgccataaccggtaaaaaacacactatgcccagtaatacagcaatggttttatgcatatcacactctggtgggtaattatgattattaacaacaaaccctcagtactactatagacgtgacggtaagaaagtgggagtaaaatcagataactacactcaggaaagatagaaatgcgtggcaataacggcgcataaaataagcacgataagaatgagctcaaagcggtagcgagacacttttttgccctcccggaaggcggcgctaaaccagaacgatttagcgccgtaaaaacgggcgcgggggcgcgccgcagcatgttacgacttacgcagctggttgcgaagttgtttttgacgtagatttggctggggcttttttgccatcttttttctggtgctttttagccgcctgcgctttttgctcaacggtttttttatgctgttttttgtggtgctgggtggtctgggttgttttggcaggcgctgcggtttttgcaggcgttgcagtctcagccgcgaatgctgcggaagagagacccattgcagcggcaacaaccagagctaatacttttttcattttgataccctcgatttggttttcattcaaccccactgcggggccggtgaaatgactatatcgctgttatcaaaaggcttccgtgagtgattggtttcggcatgtaacgctatgtacaatcccccggtaacgcgatgtaagcccccaccataataggtagctttacgttaccggccgttatttttggtcgcagagtcggtaatatccgccctccagaataacaggcacaccgtatatgaatccgataatctgggtggtatttacgcttctggcgctggatgcaatcagagaagtcatgggcgtatcaagcctggcaggtctgtggtgaacagtgagtcgtggcgtgaaaccagcccggcgatagcgcacgttgctatcgccggattattgtctatggaaaacccccagctaggctgggggttccggaaagctttcagctttaagccagttattaaaaccccttttgatttgttaaaacatcttgcggtctggcaactgcaaaagttcaacaagaaatcaaaagggggtcccaatgggggacgaaaagagcttagcgcacacccgatggaactgtaaatatcacatagttttcgcgcccaaataccgaagacaagcgttctatggagagaagcgtagggcagtaggcagcatattaagaaaattgtgtgaatggaaaaacgtacgaattctggaagcggaatgttgtgcagatcatattcacatgcttctggagatcccgccgaagatgagtgtgtcgagtttcatgggatatctgaagggtaaaagtagtctgatgctttacgagcagtttggggatctaaaattcaaatacaggaacagggagttctggtgcagagggtactatgtcgatacggtgggtaagaatacggcgaagatacaggactacataaagcaccagcttgaagaggataaaatgggtgagcaattatcgatcccgtatccgggcagcctgtttacgggccgtaagtaacgaagtttgatgcaaatgtcagatcgtatgcgcctgttagggcgcggctggtaagagagccttacaggcgcatcagaaaaacctccggctatgccggaggatatttatttcttttcaggcgtgaagacgatgatgtagccgcgtcccgaccaggatggccagcaccagcattagcgcgataaaaccacctacgccgttccagccgtaactatgccagaatacaccgcctagcgtcccggcaatactggaccccagataatagctgaaaagataaagtgacgaggcctgtcccttcgcccggcgcgcacgcgggccaatccagctactggccacggagtgcgcggcgaaaaagccggcggaaaaaagcagcatcccggcaaaaatcagccaaagcgaggtaaaaagcgtcagtaaaagcccgcccagcattactgcggtagagaacagcatcaccggcccccggccatagcgtgaggtcattgcgccagctttcggcgagctccatgtgccggtgagataggctacggataacagtccgaccacggcctggcttaattcccagggggagagcatcaggcgataaccaatgtagttaaacagggtgacgaacgcgcccatcagtaaaaaaccttccgcaaacagcagtggtaaccctcgatcgcgccagtggagacggaaattaataaatagcgttttaggccgtagcgacgtgggacggaaatgttgcgaggcaggtaaaatcttccagaacatcagcgcggacgccagcgcaaagcatccgatggccgccagcgcgatgcgccagttaaaaaagtcggtcatgacgccgcttaataaacgcccgctcatcccgccgatggaattaccgctaatatagagccccatagagaaagcgacaaagctgggatggatttcttcgctcaggtaggtcattcccaccgcggcgacgccgcttaacgacagaccgatcagcgcgcgcataatcagaataccatgccagctggtcatcatggttgataacaatgtgcagcaggaggctaataacaaggcggtgaccatcaccggtttacggcctatcgcatcagaaagcgggccggtaaaaagtaagccgatagccagcatggcggtagaaatagaaagtgaaacgctgctgctggcgggggagacgccaaactcctgggaaagtaccggtagtataggctgaacgcaataaaggagtgcgaaagtcgccaggcccgcggaaaaaagagccagcgtgacgcgcatgaaaggcgctgtaccgcgtttaataaattgaaccggctgagaatggcgttgttcatcgatatcgctcgccgtggcgtcatcgagaatagttgtacgactcacgttaaatccttgctttacatctccgtcaacaggagacgggtataaccgacatgtaaagcatagaaaaagcaaaatattctgtctaatatattaattgtctcaaataagacgttaaaaatatgaatatcgaattacgtcatttacgttactttgtggcggtagcagaagagctgcattttggtcgcgccgccgcgcgcctcaatatctcgcagccgccgctcagtcagcagatacaaattctggagcagcaggtcggtgcgcgattactggcgcggaccaaccgcagcgtagcgttaaccgccgccgggcgacagtttctggcggatagccgacacatcctgagtctggtaaacgacgccgccgctcgcgccgagcggttgcatcagggcgaagcgggcgaaatccgtattggttttacgtcttcagcgccttttattcgggcggtatcgcataccttttcgttgttccgccagtcctatccgggggtgcatatgcaaacgcgtgaaatgaatacgcgtgagcaaatcgcgccgctcaacgaaggcgtactggatattggcttgctgcggaatacgccgctgccagacacacttaatcgcgaggtgattttgcatgagccgcttatggccatgatcccgcgcgaacatcggctggcgcaaaagccagtcgtcagtctgacagaactggcggaagaacctttcgtctttttcgatccgcatgtcgggacgggtctctacgacgatattctcggcctgatgcggcgctataacctgtcgccgaccatcacgcaggaggttggcgaggcaatgactattatcggtctggtggcggcgggactgggcgtctcgattctgccggcatcctttaagcgtgtacagatgagcgagatgcgctgggttcccctggcagaagaggacgccgtatctgaaatgtggctggtatggccaaagcatcatgaacagagtcatgccgtacagcggttttgccaactgctattactggctgcccgacaggattaattacgcttaaaaagggtgaaaatgtgcagttaatcacacggctaagcaaaaagttgacggcgagtattgaagtgtttcaccatagcacacagattatttcggagcgcgaaaataaagggagtgagcggtggttgctgatagtcagcctgggcatatcgatcaaattaagcagaccaatgctggcgcagtgtatcgcctgattgatcagctcggaccggtatcgcgaattgacctgtctcgtctggcgcagttggcgcctgccagtattacgaaaattgttcgcgaaatgctggaagcgcatttggttcaggaacttgaaattaaagaggcgggcagtcgtggacgtcccgccgtcgggctgatggtggaaacggaagcctggcactatttatctattcgtattagccgtggcgaaattttccttgcactgcgcgatcttagcagcaaactggtggtagaagagtgtctggcgctgccgttaaacgaagctacgccgttgcttgagcgaattattacgcacgttgatcggttttttacccgccatcagcagaaactggagcgtttgacctccattgccattacgttaccgggcattatcgataccgaaaacggtgttgtgcaccggatgccgtattacgaagatgtcaaagagatgcctttgggagatgcgctggagcggcacaccggcgtaccggtttacattcagcatgatattagcgcctggacgatggcagaggcgctttttggcgcctcacgcggcgcgcgcgacgttatccaggtggtgattgatcataatgtgggggcgggcgttatcaccgacggtcatttgcttcatgcgggcagtagcagtctggtagagattgggcatacccaggtcaatccttatggtaagcgctgttattgcggtaatcatggctgtctggagaccatcgccagcgtcgatagtgtgctggaacttacgcagcttcggcttaatcagtcgataagttcaatgttgcatggccagccgttaacggtagattcgctgtgtcaggcggcgatgcagggagatctattagcaaaagatattattagcggcgttggcgcgcatgtcggacgcattctggctatcatggtgaatttatttaatccgcaaaaaattcttattggttcgccgctaagtaaagcggctgatattctttttccggccattgctgacagtatccgtcagcaggcgctgcccgcctacagtaggaatacggtagtggaaagcacgcagtttaccaaccagagcacgatggccggggcggcgttggtaaaagacgcgatgtataacggctctttgttgattcgtctattacagggttaacattttttaactgttgtacaaaaatttgcgctaactcaagctgattgcccttgccatatcttagactttctccactgtattattttcctggcttatattttcgaagcataacggtggagttagtgatgctgaagcgtttctttattacaggtacagacacttctgttgggaagacggtggtttcccgcgcattactacaagcgttatcgtcgggtggtaagagcgttgcagggtataaacctgtcgctaaagggagcaaagagactccagaagggatgcgcaacaaagacgctctggtattgcaaagcgtctcttcgctggagttgccgtatgaggcgattaatccgatcgcgttaagcgaagaagaaagcagcgtcgcgcatagctgtcctataaattacaccttgctgtccaacggtctggcgagtctgagcgataaagtggaccacgtggttgtggagggcactggtggctggcgtagtttgatgaatgatttacgtccattgtccgaatgggtggtacaggaacagttaccggtattgatggtggtggggattcaggaggggtgcattaatcatgcgctactgactgcgcaagctgtcgctaatgatggactgcccttaattggctgggtggcgaatcgtatcaatcctggcctggcgcattatgctgaaattattgatgtgcttgggaaaaaactgccagcgccgctgattggcgagttaccgtacctgccgcgcgccgagcagcgtgagctggggcagtatattcgtttgtcaatgctcggcagcgtgctggcggtagatagaatcatggcgtaacgttcgcgagagcactgacgcgactacacaggcaatcagcagaccggggagtaactgatactcgccggtcatttcacaaatcatcagggtggacattatcggcgcatgagttgtcgccgccagtagcgtcgccatacccgccagccccaataaaatcgctatttcatccgagcctggcagccagaatccccatatccgacccagaaacattccaatggataatccgacaaataatgttggcgtaaagacgccgcccggcgcgccagacccgctgctggcgagcaccgccaggattttgcacgcaaaaattccgccaatcagcgagaatagcggcggggagagcaaaaatgattgtacgacgctatagccgtttccccataccgtgggcgtgagtaacgacagtaatccgacaataagcccgcccaacgccagttgccagggcggggacagttttaagcgtaagaaactattatggctggccgtcatcagccacatcagcaacggaccccacagaccggcgaccagaccggtactgactatcatgacgtactcccgcgcgtagagatcaacggtcagatgtacggtatagagtagtgaatcgctaccgtttaatacatgggtggttagcagggcgacgacggcggaaacgacaaccgggccgagggaagccagcattaaggtaccgaacaggatctccgcgataaacaggctgcccgccagcggcgcatggtaagcgcccgccatgcccgcagcggcgccgctggcgatccataatttccattcctcacgcggcgtgaagcgtcgggcaaagctggacgccgccagcgcggcgaggaggatcattgcgccttcgcgaccaattgcgctgccgctgaccacgaccagcagcgaggccagcgatttcaccagactggcgccaacgtcaaattgcccgtcggtttgcaatgcttccatatagtcagtgggcgcatgggggcgctgttggttcattttttgccacccccacagcaacagaccagcggccaggccgccaagcgccggcgtaatcagccgtcgccagggcgaaagcccctcagccgcattcaccagactgccggtgtcattactcaggaaaatccactccagcaattgcatcgcatgacggaaggcggcgacagccagcgccgcgagaataccgatgagcgtagcgatcagcaggcgacgaaacatcgcgcgcagatccgggtaagcgtgtaaacgatgcatgagcgggtaaacagggagtttcaggatagcctattctgcggggaaatggcgtcagacgcaaaagcactatgtgcgatataatattgcgtacaataatgatactgccggatagcgagaggcgatccggcggcaacgttagctgctttcgtgaatatttagcgcccgacgagtgcggcctgagctgagataatcggcgatgtaatcctgagagatttcaccgttatagcgtccgtcttcatcaacgatcggcatccagctggtattactttcgtacaatctggacagcacaatacgcagattatcttccgctttgcccgtaatacggaaaggatgggtgatatcggcgcagattccgctggcgttccgcgcctcccggcgcttcacaaatcccagtggcttaccgtcgttgtcaatgacggtaatggcgcgaatatcgtgatcatccataatgccgaacgcctcgcttaacggcatggaaggccgcgcggtaatggttggctgttggtcggtcacatcgcctgcggagaccagtagcaaacgctttaacgttctgtcctgaccgacaaacgacccgacaaactcgttagccggcttggccagcagttcatcaggactggcgcactgtacaattcgcccctgacggaacacggcgatacggtcgccgagttttagcgcttcgtcgatatcatggctgaccagcatcacggtcttttttagcttacgctgcatatccagaaactggttctggatcacttcgcggttaatggggtccaccgcgccgaagggctcatccatcagcagtaccggcggatcggcggccagagcgcggatcacgccaatacgctgttgctgtcccccggacatctcctttggatagcgatgcagaaattttctggcatccagcgccaccatgtccatcaactcttcggcgcgttgcttgcagcgcgctttgtcccaacccaacatgcgcggcacaacggtaatattttcttcaatcgtcatattaggaaacaggccgatctgttggataacatacccaatattgcggcgtagcgttaccgtatccatatcgttggtattctcgccgttgataagaatattaccgctgctgggcgcgatcagccggttgatcatctttaacgtggtggttttgccgcagccggagggaccgagtaagacgcacatttcgccttccggcacgttcaggttgacgttgtcgacggcttttagcggctgaccctttttctgtacaaattgtttggtgagattttccagttttatcattatcgtatccccttaggtgccagtacgacttgcagacgatgcaacagccagtcaagtacaattgccagtagacagatcatcagcgcgccggcaattaacatgcgaatatcgctgccgctaatgccgtttaacagtagcagccccagaccgccggcgccgatcaccgcggcaatcgccatcacgccgatattcatcactaccgcggtgcggatacccccgaaaataaccggtagggccattgggatttcgacccagcgcagccgttgccagaaagtcataccgatgccgcgtcccgcttcacgcagaccgggcggcaaactatcaagcgcagtatgggtattccggacaatcggcagtaaagagtagagaaaaacggccgtcacagcgggcagaacgccaataccatgcccgatcagcgaaaagagcgggatcattaatccaaacagcgcgatagacggaatggtaagaagtagcgtggcggcgcccaataccggcgttgccagccatttgtggcgtacaatcaaaacgcctaacggtacgccgatgataatcgccagaccgacggccagcgcgactagccagagatgctgaaaggtaaggctggcgagatagcctgcgttatccagcatataatgtatcgtatccataggcgctccttacagcagacctttgtcctgcaaaaattgatgggctacctgttgcggcgtgcgatgctcgatatcgacctgggcgtttagggtcgatatcacatcgttattgagcaggccggaaagggtgtttaaggcgtcatcaagaccaggattggcttccagcacctctttacgcaccacgggcgtgacagcgtaacttggaaagaagcctttatcatcttccaacactttcagatcaaaccctttcacccgtccgtcggtggtatagaccagcccggcgtcaaccagtccatcccgaacggcgttatagaccagccctgggtccatctgtcgtatttgcgggcgatcgagctgcatctggtaggcttgctgaaggggcttcatcccgtcgctgcgcccggcaaattccagatcgaggccgagcatccagttgtggtcaggatcgttctgccggacttgttcgatttttgccaccatttgcgagatggtggtgatattttccgactcggcgcgtttacgctgcatcgcgaacgcgtaagtattgttcatgtcagccggtttgagccataccaggcccagcttcgcatccaggcgttttaccgtgtcgtaggtttcctgtggactcatgcgcttatcgatacggttgaaaataatcagcgatgtaccggtatattcccaggtaatatcaatttgtttattcaccatcgcattacgtgaaatcaccgcggcgatattggtttgcggctgaacctgaaagcctttcttctgcaaatactgaacggtcatagcggaaagaatatgctgctcggtaaagcttttggtggcgagaaccagcggcgcggcctgcgtctggctactgaacaacagcgttgtggcaagccatcccaacaggtgttttttgaatctcatttaacgctccttattgttatttatgcgttcagacggtatgagggctaaggcgtcgcccaaaccaggcaagcagagtgtcaagaatcagcgcgaataacgccgtggccgttgcgccgagaatcaacgtcggaaaatcgttgagataaatccccggaaaaatcagctcgccgtagctgctggcgccgatcagaaaggccagcggcgcggtgccgacattgatggcggtcgcgatgcgaataccggacagcatcactggccacgcattaggtagctctacctggcgaagccgctgccattttgtcatcccaatcccgttcgccgcttcaatcagtgaggcgggaacggaacagaggcctgcataggtattgcggacgataggcagaagagaagccagaaatagcgcgacaatggcgggcgtatcgccgatcccgataatcaccatcgctaaggccaggacggccagtggcggcaaggtattaccaacattaaagatttgcatgacatattcagcaaatccttttgccgcaggtcggctgagtaaaatcccgctcgggataccgaccagtaaagcaaaaaacatggacgtaaagaccagcatcaaatgccgttgtccgagatacagcagatcgacctgacgcgctttcagcgtctccagaccgattccccagataaacagcgccagtaacagcagaatgacgatagtgaacccaagtacgcgttttagggtgaggatgtgcattgcggtgtgtctccctgtttgcatgtgttatggcgacgttaagagtcgcgtgttgttatgccatgttccggcagggtgctttgagctatagcaacaggttgggaaggattccagcggagcgtgatgtttaacactgttaaacatctattaacaattatgttttgcccttatgcggcttagcgtgaacattcacgataaagaattatcttaaaaatagaagcgaggtgtgacgttgtcactttttgtaggtaaaaataggccacaatgggagaaaaggcaggtaaaatcctgccttttgtggggattaacggaataacggttttacagcgacgggaataatgagttgagcttgccattgcgccagagtcagacgcgccagttgccccaacgcctgataaaacggatgcccggcatgatcgataaatacgtccagaaagcggggcgaccacggaaacagatgccaggccaggagttgttcgcattcatgatgacggccattctcggcaagccaggccgccagcaacaacagcgccccaaaatgatcttctggctcgttttgctgcatttcaaactgaatcccgttttcgcgcatccactgacgtagcgccaacgtagaatcgccaaataatacgctctcacgatccagccagacggaaccccacggcggagacggcagagcgtaagggccgataaacaggcgctgccaggcttgtggcaacgactcttcgctgtgggtcttaaacatagccgccacaggtgcaagcgcctcggcatcaagcggccactgcgcctgccagtcgtcgtttaatagcgcctggaccagaggagcggtttcgtggctttccggcgaataataaaacaacgcgccaagaacacgcgccgttactgcaaaatcatcacgttgtaaaaaagtggtcattcaaacaatcccgaaaggtgcgggtcgccccgcacgcataaattaacctgcgacggccatacctacggtcatatgcaggccataaaaaagtccgcggccaataatttcgcccgccagcaccagtacgacaccgagcagcaaaccaacggtatgcggttcgcggcgacggattagtggacatagccagcaacctaatccggcagcaagcaagacaatgcgccagacctgtagcataccgtaatccggtgcgagatggctggcctgttgcacggaactgtgaatggctgagagggacagtccctgtagtacgatgaccgccacgcacaccaccaacgccaggccgctaatactggcaaacgtcacgctgcaaaatgggacgcgcgcgatgcgtagcagtagcgccgcaaacaccggaccgcacaggaatgccgtgaggaaaaaggccagcgtggtgtagccattataccaggttggcacggtatctatctgataaacgagcgtcattgcccagatgaatgcaacgccgagcgccatactgaccagcagccacactttacccagcgccgggggcattttaccgagtaccgccaccagccaccagatgccgcctacggcaaagaacaccgatcctgcggcgatttcattactcagtgcggaagcgcctacgcggttaagcgagttaaacgcgcgcatcggcaagccgagatgcataatcgacgcgaggaatcccagtcccatcaccagccacagaaaaaacatgctgcgcacgatgcgttgttttgccacatcgtctttggtggttaaccagccatatccactcacgatcagcgccccggccacacattgacccagcaccgtaaacaggaccagcggccattcatgccatccacttcccatcttatacctccttcggattggccagataaccggtggtgtccccggtcgggcggctgttggcgttgggtttaatcacaatattcggcttcgtgaaatgcgtgcgcggcaacggcgcgacggcagccagctcaccgtgttttttgcgcagttcgtctatcgggccgaaatccagcgcccgcagcgggcaggattccacgcaaatcggtttcttgccttccgccacccggtcataacagccgtcgcacttggtcatatgacctttggccgcgttgtactgcggcgcgccgtacgggcaggccatgtggcagtagcggcagccgatacagacctcttcattcaccaccacaaaaccgtcatcgcgcttgtgcatcgcgccgctcgggcagactttggtacaggccgggtcttcgcagtggttacaggagatggagagatagtaggcaaagacgttctggtgccagacgccgttatcttcctgccagtcaccgcccgcatactcataaatgcggcggaagctgacgtcgggagtgagatctttgtagtccttgcaggccagttcgcaggttttgcaaccggtgcaacggctggaatcaataaaaaatccatactgggttgtcatcggttactccttacgccttttcaacctgaacaagattactgtgtgacggattacctttcgccagtggggaaggccggtgcgacgtcagaatgttaatggagccgccgcgatcgactttgtcgccaaacatgtcggcatttaaccaggcgccctggccgatagcggtgacgccaggcaatatgcgcggcgtgacttttgccggaatgagcatctctccattctggttaaagacccgcacggtgtcgccgtgctgaatgccgcgcgcttgcgcatcaatcgggttgatccagatctcctgcggacacgcctgttgcaggacgtcgatattgccgtagctggagtgggtacgcgctttatagtggaagccggttagctgtagcgggtagcgctgacgaagcggatcgtcccaaccgtcaaagcctggcgtataggcgggtaaaggatggataatctcatctttcttcagctcccacgtgttggcgagggttgccagacgctcggaatagatttcgattttaccggacggcgttttcagtgggttggcggcagggtcttcgcggaatgagcggaaagcgacgtagtgctcctccgggcattttttcttgaaaatccctgtctgtttcatctcttcgtaatccggcatttccgggttacgcgctttggtttttgcgtgcaggtatttgacccactcatgctgcgtgcggccttctgtgaaggtctggtatacgtccggaccaagccgtttagccacttcactgagcgtccagtaaatgggctttctttcaaatttcggcgaggtggcgggctgaccaagaatgacatagcccatattgcctgcggattcgtgggaaatcagatcttcctgctcggtcggcattaaatcaggcagcagaatgtcgcaatattttgccgacgcggtcataaagtgctcgatgccgacgatcatttcacatttactgtcgtcctgaagcacctcgtgggtgtgggcgatatcgccatgctgattgatcagcgtattactggcgtagcaccacaaaaatttgatcggcacgtcgagcttgtcttttccccgcacgccgtcgcgtgtggcggtcatttccgcgccatgatcgatagcgtcggtccaggtaaagaccgaaatctgggtttttaccgggttctccagcataggaaaccattcgacgcccagatcccaggtgccttcgcgcacgccggaattaccgccatttatgccgacgttaccggtgagtacagacaacatggcgattgcgcgtgcggtctgctccccgttagagtggcgttgcggtccccagccctggcaaatgtaagccggtttcgccgagccgatttcccgcgccagttgaatgattttttccgccggaatactggtaatctgcgcggcccattgcggcgttttagcaataccgtcttcgccctgacccaaaatataggctttatagtgcgcgttacgcggggccgaggcgggcagagtggtttcgtcgtagccgatgcagtatttatccagaaacggtttatcaataagatcttcggtaatcagcacccagccgattgccgccgccagcgcgccatcggtacctgggcgaatcggcagccactcgtcttcgcggccggcagcagtgtcgttataacgcgggtcaatgacgatcatccgggcgttggagcgttcgcgcgcctgttcgacatagtatgtcacgccgccgccgctcatacgtgtttccgcggggttattgccaaacatcaccaccagttttgtattggcgatatcatccggactgttgccgtcgttgccgccgaacatatagctcatggccgcgctgatttgggcggtgctgtagctaccgtaacggctgagatagccgccgcaggcgttcatcaggcgatacggtacgttagaattggtaatattgccgccgtccacgccggtaccgtaaaggacatgtaccgcttcgttgccgtagtccttgaggatgcgtttaaggttatcgccgatggtatccaacgcttcatcccaactgatacgttcgaatttgccttctcctcgtttaccaacgcgtttcatcggatatttcaggcgatcgggatgattcatccggcgacgaatagaacgaccgcgcaggcaggcgcgtacctgatggttgccatattcatcgttgcccgtggtatctgattcaacccaatatacggtgtcatcttttacgtgcaggcgcagcaggcagcggctgccgcagttaacggtacatgaactccagaccgctttttctgccatattgccagatgcgaggtctgctgcggcgtgggcgatgcgggagaacggaagggtgaaagcgctactggcaagcgcaaggctaccgatagcggaggttttcaccaggcttcgtcggctgatactggccgccattaatgcctcagggttggtgattttcataacagctcctcactatgctcatccaaaaaagagttttaaatgtcgttgtgttcgcaaaacggggagctccgggcgcgtaaaaacgccccggagcaggcggcttagattttttcgatttccaccagatttgtatgttgaggattcccttttgccaggggggaaggacgcagcgtcgtgagcgtattgatgcaggcgccgtggtcaattttatcgccagccatatccgcattatgccatgcgccctgacccatcgcgctgacgcccggcagaatacgcggcgtgaccttggcgggtagacgcacttctccacgatcgttaaagacgcgaaccttatcgccattcgcgataccacgtttttgcgcatcaagcggatttatccacacctcctggcgacaggcggcctgcagaacatcaatattgccgtagcttgaatgggtacgggatttatagtgaaagccaaacagctgtagcgggaaggtgctccgcttcggatcgtcccatccttcaaaagtaggggtataaatcggcagtgggcttatcacgtcgccttccgccagctcccaggtactggcgatgtgagcgagtttgcttgagtagatttcgattttaccggacggcgtttttaacggattggcctgcggatcttcacgaaattttttataggcgacaaagtggccgttgggatctttgcgtttatagatgcccattttttttagctcgtcatacgcgggcaatgccggatctcttgcctgcattttggcgtacagatattgcagccattgcgcctgggtacggccttcggtaaaccgctgatacacatcgtcaccgaggcgtctggcgatttcgctgagtacccagtagatgggcttgcgttcaaacttaggcgtcgtcgccggttggataaaaatcagatatcccatattgccggcgtaatcattggggatgatatcttcctgttcgacggtcatgagatccggcagtaaaatatcggcgtacttcgcggaagaggtcataaaattgtcgatgaccacaatcatttcgcattttgcttcatcctgaagaatttcatgggttttattaatatccgaatgctgattaatcagggtgttgccagcgtagttccatagaaatttgatcgggacatccagcttatctttgccgcgtacgccgtcgcgcagggcggtcatttccgggccgcgcgcaatggcgtccgtccagctaaagcaggagatggcggttttaacgggattctccaggaccggcagacgttcaatggtaatggtgtaagtggattcgcgtgcgccgccattaccgccatgaatgccgacgttgccggtcagaatcggaaacatggcgatggcgcgagcggtttgttcgccgttcgcctgacgctgcgggccccaaccctgacagatgtaggccggcttgacgctacctatctcgcgcgccagtttgataatccgatcggcggggatgccggtaatgtgtgacgcccactgcggcgttttggcgataccgtcctcgccctggcccaaaatataagccttataatggccattggggggggcgtcagccggaagggtcttttcatcgtagccgatgcaatagttgtcgagaaaaggctggtcaacgagattttcgttaatcaatacccaggcaattcccgccaccagcgcggcgtcggtgccggggcgaataggtatccactcgtcttcacgtccggcagcggtatcggtatagcgcggatctatcacgatcatgcgcgcatttgagcgttcacgcgcttgctccagaaaccaggtaatgccgccgccgctcatgcgtgtttcagccggattattgccgaacatgaccaccagtttactgttttcgatatcagatgtgctgttgccgtcgttggatccataggtgtagggcatggcgcaagaaatttgcgcggtactgtatgagccgtattgattcaacgaaccgccgtagcagttcatcaaacgcttcaccggcgaggcggaaggcgacgagcgggttatgttgccgcctacgatgccggatgaatagtggatataaacggcttcattgccgtagatctctacggtctttttcaggctggcgctaatggtgtccagcgcttcctgccagctaatgcgttcaaatttgccttcgccgcggcggccaacgcgtttcatgggatagttaaggcgatccggatggttaatgcgccgacggattgaacggccccgcagacaggcgcgaacctgatgattgccgtagacatcgtcgccagtgttatcagtttcaacccaccagacttcattatcttttacatgcagacgcagggcgcagcgactgccgcagttgaccgaacaggcgccccagacgattttatcttcttcgttgcgcatagcctgctgcaccgccgcggccgcggtacgcatcccaaacggtaaagatacgcctccggcagccagcgccagtgagccaagcgccgctgatttcactaacgtcctgcggctaacgcctgtttgctgcttttctccgggcatcactcactccattgtcgttatcgtttcgctatatattaatgactatagcgaaattattaacatgctaatgatgtaatgagtttacccctttgggagtaaggattattaatccatgtcaaagagcgttaccctccggacccggagggcaggaggaggttattgtggttcggcggatgaaccgtcctgagcgggagaggtattggctggcgcattgccgctgctggtgcgggtataaagaattttatgcgtgtcgttcgcgcaatggcccaccacctgtgagtccggctgatcggcctggtcgtataggaacgatagtgagcgtaaaattatccgccggcacgccgttattgatgatacgttgttcgatatcgctttttactctctcgcacgatcccggtgccgccatcaccagcgagggggcgctgactaacgccagagcggctattgcagttgcgattttcatcatgaactcctgtgattaatgacgatgttctaagcttagcatttttcgtgtaaataactgtatttgctaatatgatgataaatatcttttcatcctggtgacacgcgtgaagaaaccccttttactgacgttattgtgcatgatactggcaggttgtgataacccgaaatcccccgagtcttttacgccggaaatggccagtttttcgaacgaatttgattttgatccattacgtggtccggtaaaggatttcagccagacgttgatgagtgagaatggcgaagtggcgaagcaggtcaccggtacgctttcacaggaaggctgttttgatacgcttgagttacacgatctggagaataatacggggctggcgctcgtgctggatgctaattattaccgggatgctcagacgctggaaaaaaaggtgcagttacaggggaagtgccagctggcggcgttgccttcggcgggcgtgacttgggaaacggacgacaacggttttgtggtatcggcgacgggcaaagagatgaaggtcgagtaccgctatgatagcgaaggttatccgttaggtaagacaaccataaactcgcagaatacgctctctgtgacggcaaaactctccacggactcccgtaaaaagctggattatacggcagtcagccgggtggatgatcgacaggtcggcaacgtcacacagagctgcgaatatgatgcgtacgcgaaccctgttgactgccggcttgttatcgtcgatgagagcgttaagccggcagtgtcccaccattacaccattaaaaatcgtatcgattactactaaaccgggcgcggtgcgactctccgtgactaccgcgccgcgcttactgcgcggtgggtttcaggagcgtagaactggacgttttatgttcatccagatactgctgctggaagatacacatgcggatggtgttacggtattcgccgttaatgaagaactcatgaatcagctcgccttctactctaaacccgagtttacggtagatgtgaatcgctttttcattctctttatcgacgatcaaatacaatttatagagattgagtacggtaaatccgtaatccatcgccagtttggccgcgcgtgacgccaggccttttccctggtactccggcgaaataataatctgaaattccgcccgccgatgcacatggttaatttccaccagttctaccagtccggcgttttcaccgtcgcattcgacgacaaagcgccgttcgctttggtcgtggatgtgtttgtcgtagagatccgacagttcgacaaaagcctcatacggctcttcaaaccagtaacgcataacgctggcattattatcaagctggtggacaaatcgtaaatcttcacgctcaagcgggcgcagtctgaccttgtagtcacttgtcatactgtatccttacacttccttttagttatcctgcatcagggcgtaataacgcgacctgtacgacgatccagacaccgcagagtattgggttcccaataggcgttgatgttggcgctttgctcgcatttatcgcggttatcaaaggcggcatcggctttgtcccactctttttctgcgcgggtattcactttctgacgcagactgcgagtgtcgttccattgttccttttccatcgccgcttcctgacgactttgtgcgctatctcccgattcaatcaccagtttactggtttcagcgaatgcggaagtagtatatacaacggccgccaacgtaagcattgccgtcaggcaaaggcgtttgctcagcgtattgttcatcacaacatcctttcattagaggggaaaaagcggtaaaccacctgtaaattctacaccaatccttatgcctggcatatacacaagaatggccggataaccgtaacgatattctgttgtattatcacttatcatttcgtaaccaaatgaatctcatgctaaagacgactctgcttttctttgtcaccgccctctgtgaaatcattggatgttttcttccctggctatggattaagcgcggcgccagcgtgtggtggcttctgcccgctgccgcgtcactcgcgttattcgtctggcttttgaccttgcatccggcggcgagtgggcgggtttatgcggcttacggtggggtatatgtctgtactgcgctcctgtggttacgtgttgtcgatggcgtccggctcacggtttatgactggagcggcgcgctgatcgcgctgtgtggaatgctgattatcgtcgttggatgggggcgtacgtaacattgccgcgctgccagaacattttgtgatctggcagcgctttttagataaatatacttgtatggtagtagctcagttgggtaaatttcctgcatcccataatgcgatgtaaggaataaaaatgaagattgtaggggctgaagtttttgttacgtgtccagggcgtaacttcgtcaccttaaaaataaccacggaagacgggatcaccggtctgggggatgccaccctgaacggacgcgagctctcggtggcctcgtaccttaccgatcatctgtgtccacaactcatcgggcgggatgctcaccgcatcgaagatatctggcagttcttctacaaaggtgcgtactggcgccgtggtcctgtcaccatgtccgccatttccgcagttgatatggcgctatgggatattaaagccaaagccgccaatatgccgttgtatcagttactcggcggcgcttctcgtgaaggcgtcatggtgtattgccatactacaggccacaccatcgacgatgtgctggaagactacgcgcgtcataaagagcaagggttcaaagcaatccgcgtgcagtgcggcgttccggggatgaaaaccacctacggcatggcgaaaggtaagggactggcctatgagcccgcgacaaaaggccagtggccggaagaacaattgtggtcaacggaaaagtatctcgattttacgccaaagctgtttgacgccgtgcgtaatacgttcgggtttaatgaacatcttctgcacgatatgcatcaccgactgacgcctattgaggctgcccgctttggcaaatgtattgaagactatcgtttgttctggatggaagacccgacgccggctgaaaatcaggagtgcttccgcctgatccgccagcatacggttacgccgattgccgtaggcgaagtctttaacagtatctgggattgcaaacagctcattgaagagcaattgattgactatatccgcaccacgattacccatgccggtggtattaccgggatgcgccgcattgccgattttgcctcgctctaccaggtgcgtaccggttcgcatgggccgtccgatctgtcgccggtttgtatggccgcggcattacattttgacctgtgggtgcctaactttggcgtgcaggagtttatgggctactccgaacagatgctggaggttttcccgcataactggacgttcgagggcggctatatgcatccgggcgacaagccaggactgggcattgagtttaatgaaaaactggcggcgaaatatccgtacgatccagcctatttgccggtggcccgtcttgaagacggcacactgtggaactggtaaggagcgaaaaatgaaaagcatcgtaatcgaaaaaccgaatacattaaccatcgaaacgcgcgcgcttctgcagccagcatctggcgaagttcgtattaaagtgaaactggcgggtatctgcggttccgacagccatatttatcggggacataatccctttgcaaaatatccccgtgtcataggccatgaatttttcggtgtcatcgacgcggtaggcgacaacgtcaatcgcgaccggataggagaacgggtatccgtcgatccggtgatcagttgcgggcattgttacccttgttcagtcggtaaacccaatgtgtgtacctcgctggtggtgctgggcgtgcatcgtgacggcggtttcagcgagtatgcggtggcgccggcccgtaatgctcatcgcataccggacaacatcgcagaccatcatgccgtcatggttgagccgtttaccattgcggcaaatgtgacggggcaggtgaatccgaccgagcaggacgtggcgcttatctatggcgcaggcccgatgggactgacgaccgtacaggcgttgaagggggtttatcaggttaaaacggtcatagtcgttgatcgcattgaagaatcgcctgcggcacgcattgtcctgatgggattttccagcgacccgtgtgagattgtacagcagggtattaccggaaaagagctggctatttattcatcgcgtcttaatgccaataaattcccggtcgtgattgactggctgaataaagggcttattgatccggataagctgataacgcatacatttgattatcaacatgtcaccgacgcgattgagcttttcgagaaagaccagcgtcaatgctgcaaagtcttactcacgtttgcgaaataatataaatacttgcgagtaagtggtacgcatcttacctcttagagattgcctatatgacacaaataaagcatgaacgatcgactcaggatttagtgcgcgctgccgtatctggctggttaggcaccgcgcttgaatttatggattttcagttatattcactaggcgcggctctggtcttccatgagatatttttcccggaacagtctgccgcgatggcgcttattctggcaatgggcacctatggtgcaggttatatagccagaattatcggcgcctttgtttttggtaaaatgggcgaccgcatcggacgaaaaaaagtattgtttattactatcaccatgatggggatctgcaccacgctgattggcgtactgccgacgtatgcgcaaatcggcatttttgcgccagtattactggtaacattgcgaattatacaggggctgggcgccggggcggaaatttccggcgcgggtaccatgctggccgagtatgcgccgaaaggaaagcgtggcatcatttcctcgctggtcgcgatgggcaccaattgcggtacgttgagcgcgacggcgatctgggcggtgatgttctttgcgcttgaacgcgaacaactgatcgcctggggatggcgtattcctttcctggcgagcgtcgttgttatgatattcgcgatctggctgcgaatgaatctgaaagaaagtccggtattcgaaaaagtaagcgaaggcgaaaaatcgccagcgttaacgcctgcgtcagaaaatacattgggcgcgatgtttaccagcaaatctttctggctggccaccggtttacgttttgggcaggcggggaattccgggcttattcaaactttccttgccggatatttagttcagacgttattatttaacaaatctatcccaaccgatgcgttaatgataagttccgtaattggttttatcactatcccactcttggggtggttgtccgataaatacggtcgtcggctaccgtatataatattgaatatctccgcgattattctcgcctggccgatgttgtctattgtggtagataaaacgtatagccctggcgtaattatggcggcgctcattgttattcataactttgccgtgctgggattatttgcgctggaaaacatcaccatggcggaaattttcggatcgcgtaatcgcttcacccggatggcgatttcaaaagaggcaggaggcctggtggcggttggctttggccccgtcctcgcagggatcttttgtaacatgaccgattcctggctgcccatcttaattatgctggtgctctactcgtgtattggtctgatttctgcgctgttgatgccggaggtcagagatcgcgacctgagtttgcctgaggatgcggcggaagcgacagcggcagagaagttacgccactccgcaacccagacgagttaaatcgtgtcgacggtatggccggaacgttaatgcggtttcggccatgctgtccggtcacttttgtttaattagcgtaaatccaaatgcaccagggcaggcgttactctgcgactgttccgctttcagaatatagaggttataaaatgcaaaacaggcttttatcggcaaaggcgacgcttcctgattacgatcgcgcggcgctggcggcgcggatggtccatctcggttttggcgcgtttcatcgcgcgcatcagggggtttatacagatattctggctgcggagcagcatagcgactggggctattatgaggttaatcttattggcggcgaacagcagattgccgatctaaagcagcaggataacctctataccgtggcggagatgtcggcggatgcctggacggcgcgtgtggtgggcgtcgtcaaagcggcgttgcatgttcaggttgatggtctggaacgtgtgctggcggcgatgtgcgaaccgcaaatagcgattgtgtctctgaccattaccgagaaagggtattgtcattcgccagccacgggtcaacttctgctggaacatcccatgattgccgccgacctgcaaaatccgcatcaaccgctaacggcaccgggtattattgtcgaagcgttagcgcgtcgtaaagccgcaggcttaccggcatttaccgtgatgtcctgagacaacatgccggaaaatgggcatgtgacgcgtcaggttgtgacggcttacgcccgggaggtggatgcggaactggcgatatggatcgagcaaaacgtgacatttccgtcaaccatggttgatcggattgtccctgcggtcacgccggagacgctggataaaatcgaacaactgaccggcgtgcgcgatccggcgggcgttgcctgtgaaccgtttcgtcagtgggtgatagaagatacgtttgtggcggggcgtccgcagtgggaaaacgcgggcgcgacgttggtcgccgacgtggttccgtttgaagagatgaaactgcgaatgcttaacggcagtcattcattcctggcttatctggggtatcttgccggctatcagcatattaatgactgtatggatgacgacaactatcgtctgaccgcgcaggcgttaatgttacgcgagcaggcgccaacgctgaaagtccagggggtagatttacagcgttatgccgatcagttgattgcgcgttaccgtaatccggcgctgcgtcatcatacctggcagattgcgatggatggcagccagaaacttccgcagcgtatgctggactccgttcgctggcatcttgctaatcatagcgattttgatttgctggcgctgggcgtggcggggtggatgcgttacgttggcggcgtggatgagcagggtaaggcgatcgacgtcagcgatccgctattgccggttattcagcgcgccgtggcaaacagtgaagaaggcgccagtcgtgttaaggcgctgctgggaatggctgaaattttcggcaacgatttgccgcaggcggcgcggtttacgcaaaaagtgcaagaagcctatgacagtttactgacatatggcgcgaaagcgagcgtggcgaaatatgccgagcgcttgaaatagcgtaacagagacccggtagcattatgctaccgggaaggccggagcggttcttagcggccagtggtatcagttcatgccaagacgaatcagttcgactggcgcgaatttaccttcacaaccttcgacaatcaccgttttgccgcggcgaatttgacctgcatccagaccttcgctctcaatggctttgataatcccggtatggcccgtgccgcttatcatgacccggctaccggtggtgattgcgttacggttacgatcgtatgtcatcatggtgttttctcctttcaaacttactgccaaagcccgcaggtttccccgcatgacgggcgacatataaatacgcttatcgttgcggattttttttgtttttgatcaagctcacggctttttaggcgggaatgtgcagggcgagaaagcggagaaggcgtctcaccccgacgttaaagggggttactcttcgctaaaccagccgctgttttcctgacggataagctgaacggattcgctaatttcctgcaaatgctgggtcattgcgctctcaaccgcattgccgtcacgattttccagcgcggagaaaatatcatggtgctggcgcagcaacatctccggcggagaaacatgatccagactcatatagcgaacccggtcaattgtcgctttgatattttcaatggtatcccacgctaactggcaatcggcgatctgcgccagtttttggtggaaatcgtcatcaagctggaaaaaatcatcaatctgtttgcgctcgatggcaatatgttgcaggtgcaggttttgcgccagttgatagcactggttgtcggtgatcatcgccgccgcacggcggaccaccgcgcattcgatcgcctgccgaacaaagcagccattctgtacctgagaaagcgaaatcttattcacataactaccgcgctgagggcggatctgaatcaacccattttccgccagctttataaaagcctcgcgcaccggctgacgcgaaacgttaaaacgggttgagacctctttttctgatagcggcgtgccaggcgggataagacaatgcacgatatcacgccgaagaatacggtaaatttgctggttgacaggctgtgtagggttaagctgcgtttcgacggtcattcattcttactttttaggcggttgacccggatactctaccacttttccgtggcggtctataccgatcatgtttctggttgcagatacgtttgccagggattacccggcccgcagaccgggtataaccccttagctacggtggacgctgagccctgcgaaggattgggtaacaggcatcatttcaacggtattaatattcacatgcgcggggagtgtggccacccaccataccgcttcggtaatgtcttctggcgtgagcgcggtggtattttcgtaggttttacccgctttctcatcgtcgcctttgaaacggacgctggaaaactcggtgccgccaaccagacccggttcaatgtcggtcacgcgaaccgccgtgccgtgtaaatccgtgcgcaaattcaggctaaactggcgcacaaaggctttcgtcgcgccatagacgttgccaccagcataaggccaactgccggcggttgaaccgatgttaatgatatgaccgcgattacgttcgaccattcctggcagcacggcgcgggtcatataaattaagcctttattattagtatcgatcatagtttcccagtcttctacgctggctttatgcgccggttcaagacccagcgccagaccggcgttattgaccagcacatcaatatcgcgccactgcgcaggcagagaggccatcatctcttcgatggccgcgcggttgcgcacgtccagttgggcggtcaatacgttctcgccaagctcatcttttaacgcttgcaggcgttcatgacgacgtcccgtggcaatgactttatgtccattctcaacaaaacggcgtgcaatgcactcgccaaaccctgcggttgctccagttactaaaacgatcatcacacagttcctcaacgctttttgtgttgtattaccatagcacgcggcgtttatgaaagggtaatcctggttaacacggttgcggtcagcatagggggaagcttactcttatgatcaacctattttcaggagtgaaaaatgtcgacgaatcctttgttagaccagagtatgttgccttatcaggcaccgcgttttgatcggatcaaagattgccattatcgtcctgcttttgatgagggcgtgcggcaaaaacgcgtggaaatcgaggccatcgtcaatcatccggcggcccctgattttacgaatacgcttctggcgctggagcaaagcggggcgcttctgtcacgcgtcaccagcgtttttttcgcgatgacggctgcgcacactaacgatgaactccagcggttggatgaggccttttctgccgagctggcggcgctctccaacgatatttatctgaatagcgcgttattcgctcgcgtggatgccgtctggcaacagcgtcactcactggggctggatgatgagtcgctacggttggtcgatgttatccatcagcgttttgtgttggcaggcgcgcagcttgccgaagaggataaagcgcgactgaaagtattgaatactgaatccgcgaccttaatgagtcagtttaatcagcgtctgctggcggcaagtaaagcgggcgggctggcggtagatgacgcgcattgtctggaaggattaagcccggaagaaatgaccgtcgctgctgaagcggcgcgtgaaaaaggcctggaggagcgctggttcattccgctccttaatacgacgcaacagcctgcgcttgctacgctgcgcgatcgccagactcgcgaaaatttattcgcagcgtcatggactcgggcggaaaaaggagatgcccacgatacccgcgctatcgttcagcgtctggtagagattcgccgctgtcaggcaaaactgctgggtttccccaattatgccgcatggaaaatggccgatcagatggcgaaaacgccgcaagccgcactgagctttatgcgtggcattgtgccgccagcgcgtcagcgggtactcaatgaacaggcggaaattcagaacgtcattgatggtgagcagggcggctacaccgttcaggcctgggactggatgttctatgccgaacaggtacggcgggaaaaatatgcgttagatgaagcgcaactgaagccctattttgccttaaatacggtgttgcaagagggggttttctggaccgccaaccagctattcggcatcaccttcgtcgagcgttttgacattccggtgtaccaccctgatgttcgggtgtgggagattttcgactccgatggtgtcggcatggcgttattttatggcgacttcttcgcgcgggactcgaaaagcggcggcgcgtggatggggaattttgtcgagcaatccacactcaatgaaacccggcccgttatatacaatgtatgtaactatcagaaaccggttgatgggcagcctgcattgctgctttgggacgacgttattacgctcttccatgagtttggtcatacgttacatggtttgtttgccgttcagcgctatgccacgctttcaggtaccaatacgccccgcgactttgtcgagtttccctcccagattaatgagcattgggcgagccatccacgtgtgttcgaacgctacgcgcgtcatgtcgacagcggtgaaaaaatgcctgctgatttacaggaaagaatgcgcaaggcgagtttatttaataaaggttacgatatgactgaattgttcggcgccgcattgctggatatgcgctggcatatgctggaggagagcgtagcagagcagtctgtcgctgagttcgagcagcaggcgctggccgccgagcatcttgatttaccggcagtgccgccccgctatcgcagcagttattttgcccatatcttcggcggcggctacgcagcgggatactacgcctacctgtggacgcaaatgttagcggatgacggttatcaatggtttgtagagcagggcggcctgacgcgtgaaaacgggcagcgttttcgtgatgctatcctttcccgggggaatagtactgatttagaaacgctttattcagcctggcgtggacatgaaccgcatattgacaccatattgcaatatcgtgggctcgatcactaagctgatacggttgttcggcactgtcgaacaaccgcctgaaaatgaatcctgcacttctgatgacagccagttaaatttatggggttaagttgtctgaatataacgagggcgtgcattcggatttttctacttattttcccgtggtggcttgattgccaaagatttattaccgcttcgctgttgatgttttcaaaaaatatattttccgccatgtggtggtattatgtaaataatgcagaaatgaatttaacactgcgcacagggcgactagatttagaactgtatcacatgatatgagaagacatatcatatttaaaacgcaacatcatcatgaggattatattatggcagaacatcgcggcggttccggtaattttgcagaagataaagagaaagcctcagaagcaggtcgtaaaggcggccagcatagcggtgggaactttaaaaacgacccacaacgtgcatctgaagcgggtaaaaaaggtggccagaatagccacagtggcggacggaaatccggcaattaattttactgctgatatttcataaatatattctgaaatattgcacatacgatgcgggccataggctcgcatttttttattctgaccgggagttattctgaccggtcagatgaaattattgtttatgctttcttcgttaacagaaaaagcaattcagcgagggcgaagcgtacgcatttttccaatacttcctgacaatctccgttgaaatgttgtcggcttgtaaaagttgtattgttaatattccaggcaaaccaaactgtgcccgccggcgtgccatcttcgccgccttccggaccgccatagccgctgatcgctatgctgatattgacctcagcctgatccttagcgccctgtgccatttcagtaacaaccgcttcgctgacggcggtatgttcggcaagactgtggcgttgtacgcgtaagatttttgctttggcttcatcagtaaaggtgacataccccacaccgtaaaatgagggcgtatcttctgctgcgcacaatgctgacgccagtttcccgccagggcaggattctgcactggtcagacggagtttctggttaaccagtaaatcaccaagtttttttgtcaggctatcgacggattcggcttcatcaagggtgacaatatcgtgctgttctaatctcatcgtttatttttccgttacagagacaaatgaaatctgttcgttcttctcaagtatggcatatttattttatgacattgtcagtgaatgattattttatccagttaccaacaaacccgctgttgcataacttgcttactttcttacggcgatgactgtcattgattatgtggaaggccattatcctcaaaaaataaagccgattattctgaattgctatccagacgttgatgcatatgacttcagctatgtggcaagttaactattacgccgttacgctttcgcgctcactggcgctgatatcggttgcatattaatccggatgggttgattttattgcttaatattctgcgggtaaattcatgtttgtaaaaactaaaaatagcggccagacttaatacgtcaaatagacgttattaaggagagagcatgaaactacaggtggctgcatttttaagttttctgataatgccttacgcgctagcggaagatcaggggggattaaaaaaagacgtggcaccgccgccgcctcatgctattgaggatggttatcgcggtacggatgatgcagaaaaaatgaccatcgaacaggcaaaaaccctgcatgatggcgcgaccgtttcgctgcgcggcaaccttattgatcataaaggcgacgatcgctatgtatttcgtgataagtccggcgagattaacgtgataattccttccgccgtatttgatgggcgggaagttcagccggatcaaatctggacaagaaagcgaaggaaccgcttgtccgcgtgaaccgattgcaaaaataacgcgcgctaaccggcaatatccaggtcagccatacggggcatgcggctggcctgatactatgggtcttgtaaaagcgccctggggacaaaaggtcccataatgtcttattcaggtctggttgcgtatcgtttaagcttcattgatattgacggtgctacagtcgttagcgatccgttatcctcgcaagaatttgcccggtagcgtataagcaaaacacaaatctatccatgcaagcatttaccgctggtgaaccggcggtttttttttgcctgccatccagacaaaagcggccccttgcgcaacgatgcagcaaggggccggctctgcgagggattatctccgttcattaatcatcccatttgtgactgaaccaggcggccagaaatccggaaaataaaataattcctaatacaacgataaaaaggttaatactacctaacatctcgtttctccttattttagcgtgcatcctcttttttaaaaaacctcgtacaaactatagtactaatttatacttaagcaaagtctgaattgcgtatttattttactggaagggtaaagcattagaatattttcgtcagcgcccaggaatattcctgaattaccgcagttacagcagataattagcctgcaatatatagggttaacccagtgcgccagaaacagcgcacatgactggctgcagataattaacaggtgatagcctgttgcgtaggggtaatccgcattccttttaacatcagtgcccaggcgaacacaatggcgattatcaggacaacgaaaagcgaccaggcgggaagcgtcgtcaggatgacgccgctggccagcgggtttaccgccgcacccagccagcccagcgattgcgctgaaaaatagctggctttcatcccggcaggcgcaatgttgtcaattaacatatattcgccgggggcataaataatttcgccaattgtgaatactgccgctgaaagcccccaaaaaaacagattgtcgcctgaaaaaataaatccgatgagcccggcgataaaaaagacggtgccggtcgtcatcattggtcgaatattgacggcggtaagtcgacggcccacggcgtattgcaaactgaccacaataaccgcattaaccggcaggacgacggctaccactttttccgcgaagccgctatcggcaacgaccataacgtactgtgaaatacaggacgcaaaggcaacccccacaaaggaggccagaaatgccgaaagcgtaaaccacaataatgctttgtcgcgcagcagaacggagggagaccagatagcggcatttttcccctcgctggcggcaaccgaacgtgtcacccatacctgaataaagaccagcggaaatgcggaacagatagcggcaagccagaagggtaaattgatgctttgcatcaccagcagcgtgccgagcggcgggccaaccgtccagccgatattgagtacggtatagttgagcgaaaaaatccgtgtttttgttgtcgcggtgaggttatcggcgaaccaggccttcaggacggtagaaaaaaccgaataggcgcagttaataagcgcaaaaagcaggacaaccagtacgacattatgcaccattgggatggcgataaatccgcaggcgaaggcgataatcgcgagtaacatgtagcgctttttatcaaacttgtccgccagaatcccaaagccaagactaaagatgacgccgatcgttaacgcgctggtcagcgcgtagccaatcagatccacgcctaaaccgtactgacggttaagatagatggtcataaaggggagcgtggcgccgcgtccaattgtcaataacagcgatgaggcgagtagagccaacgtcgaacgtctcaatcctggattcatttttcctgcctgaaatggaggttacgtatcgggacgttttaatctaccgtgcccgcaaaagcatgatgtctgtacgctatagcgtagtcttaacataccataacgcaggattttgcccatcgtgtgttgttcaatgccatgctcacggtaaaaagaaaagtcctgttatggcgcactgatttccgataacttacctttttacaaaattttaataatgacaggggccgatgatgtcgcgtaaagacggttttttggcgttactggtggttgtcgtatgggggctcaattttgttgtcatcaaagtaggcctgcaccatatgccgccattattgctggcaggattaaggtttttactggtggcgtttccggcaattttctttgtcgcccggcctaaagtcccgcttacgctgttgctgggctatgggctgacgataagctttgggcagttcgcctttctcttttgcgcgataaagtttggtatgcccgcaggactggcgtcgttggtattacaggcgcaggccttttttaccatggcattgggggcgtttgtttttagtgagcggttacaacgtaagcagttagcggggatcgccctggcgattataggtgtactggtattgattgaagccagtctcaacggacagcatatagcgatgtcgggatttatgctgacactggcggcggcatttagctgggcctgcggcaatatctttaataaaaaaattatgcaacatagtccgcgcccggcggtgatgtcgctggtggtctggagcgcgctgatcccgatcctgccgttcctgctgtcatcgctgctactggagggggcggatcacattacgcaaagccttattaccatcgatatgacgacgatattgtcgctgctttatctggcttttgtcgccactatacttggctacggcatctggggcacgttactggggcgctatgagacctggcgcgtggcgccgttatcattgctggtgccggtagtcgggctggcgagcgccgcggtgttactcggggaaacgttgaccgggatgcagcttgcgggcgcagtactgattatggctggactctatatcaatgtgtttggatttcgtgtgcgccgtactgcgcgcgtcaggggatgaggcattatgttactaagaagacaaacgctaatttcagaccatgccgcggggtaatagcggcggacttgtcatagccagacggtactaaaaaaatgccccgcaaaacggggcaaagaggttaaaggtgttggtcgttataatagggcacgcctaattcatctgacttatcgctgttcacgctcacggggtgaaggtcatttggcggatcgcccacacagggcagaagcatcacatcgcggctattttgcgccacaggtaacaaagtttgttctgcaatgccatatccggaggcgataagtaacagacccggcagggcgggaaacagcattttcatggtgctcttcgcgtggcgcataaacaaactagtagttgccatggttcagcggcagcatataccgtgattcgccatgcatattggtgatccggtatttgtgtggcggcacatcaaaatagtttttgaacgtccgggtcaatgtttgctgtgactcaaagccatagcgttccgccagatagagaatgggctcgttgctctcttttaatttttgcgcgatttccgtcatcttacggctgcggatgtattgacctaatgaatgaccggtctcttttttaaacatccgttgcaggtgccatttggaatatcctgaacgctcagacactttttccagtgagagcggcgactccaggttatcctcgatccagtccaaaatgctatgaatagtaatagcgtcagtgttgcgtctggacatcgtcatacctcttttttgtctacggcagaattttcttgagcaaatactcaagcgttgccacttcgtccgccgttaagttttttgttaattcctgatgcaggtcttgccctggtcgttgatgacattgctcacaaattgccgcgccgtccggcgttagcttcaccagtacgccgcgtttgtcattaggattcggcagtctttcgatccagcctttgcacagcaggcggtcgagcatccgcgtcaatgcgccgagatcgacagacagcacttttttaagttcaaccggggtaatacatcccgcgcagcgtatcgagcacagcactttaaactgtgttgcggtgatatccagcggggataaatagttatttaacaggcgatcttttttttgatttaccatgtagatcaagcgacccagcggaatgatttcattgaacagatcactggtgcttttcaaaatggttgccccggcaagtaattaattttgtcagatactattgcccaggcaagtataagtcaactaaatgaattggccgatgccacgatttgctaaaaggcgtccggggtattgtgctgtgataacttgtaactaattgataattacaggttataggttgtaaaaaatattgacttgcacactggcgaaatggcgcgcctgggcaatttcactttatacttccggttcatgaaacgctgatgggtaagagatagtattatgatggatttgtttaaagcgattggattggggctggtcgtactgctcccgttagccaatccgctaaccaccgtggcgctgtttcttggccttgcgggcaatatgaatagtgcggaacgcaaccggcagtcctatatggcttcggtttatgtcttcgctattatgatggtggcgtactatgccgggcagttagttatgaacaccttcggtatttcgattccagggctacggatcgccggggggttaatcgtggcgtttatcggcttcagaatgcttttcccgcagcagaaggcgcatgagtcgccggaagcgaaaagcaaatcggaggagctggcagacgaaccgacggccaatattgcgtttgttccactggctatgccaagcaccgcaggaccggggaccatcgcaatgatcatcagttccgcttccacggtgcgtcatggcggcgagtttcccgactgggtcattatggtcgcgccgccgattatttttcttgccgtggcggtgatcctgtggggatgcttacgcagttctggcgctattatgcggctggtgggtaaaggggggattgaagcgatctcccgcttaatgggattcctgctggtgtgtatgggcgtgcaatttattatcaacggcgtgttggaaattattaaaacgtaccactaaggcgcattgtcgtctgccggaaacctgttcccggcagacgaatgtcttaatgcggttgttcttccagcgtcactggccatttgcggaatatgagcacagcccataccagcgcggcacaggcgggtatggcgccaatatagccgatggccgacattgaccagtgcaaactcacctgattgcctaccagcgcgccagcgccaataccaatattaaagatgcctgaaaatagcgccattgcgacatcggtcgcgtccggggccagcgccagtactttcacctgcataccaagccctatcaccataatcgcgatgccccagaaaatgctcagtatggccagatgcgcttcgctatccgccgcaggcagcagcagaagcagacagacaaccagcagggcaatagcgatactgacgagcgacgaggcatgacgattacccagtttaccaaacacaaggctgccgatgatcccggcgccgccgaggatcagtaacaggacggtagcaaaattcgcactgagcccggcgacattctgaacgaacggttcaatatagctataagctgtgtaatgcgcagtcaccacaacgacggttagtacatagaggctcattagcgccgggcgccggaatagcaaaggtaaactttttagtgagccggaatgctcgctcggcaatttcggtagaagcttaatcagacatagcagcgtaattaatgcgcccatgccgatggcaaaaaaggtggtgcgccagccaaaatactgaccaacaacgcgacctatcggcagcccaagcaccatggccaacgcggtgccggtcgctatcagacttaatgcctgcgcgcgtttcccggcaggggccaggcggatcgccagcgaggcggttatcgaccagaaaatagcgtgggcgaaagcgataccaatacggctaatgaccagcacggtaaagttccatgccagaaaggagagcacatggctggcaataaacaaaacaaacagacaaatgagtagcttacggcgctccatttgactggtaagaagcataaaaggcagcgacataacggcaactacccaggcgtaaatggttagcatgatgccgacctgcgcggtttgcatatgaaagctttcagcaatgtctgatagcaaaccaaccggcacaaattctgtggtattgaaaataaaagcggcaatagcaagcgtaactacccgtagccacgcgaccttgcgggaaactggattgattgtcataaaaatatttcgggttagttgcgagaaggtgagaccgcgatcttaaaacgtttactggcgaaaagacaatcattttgtgacctgcttctcatttacttcgcaggccgtttcgtcttcagtcggcgctcgccagttgggcgttaagtaactcgataaaggcctcaagttgacgcgtcatcgccccgcgtcgccacattagccaggtgctaagccagcgccacttctccgccaacggccaggcttccacctgatgatgtcctggcatactgttgagcatacttgctggcatcagcgcaatacctgcgccggcaattacgcacgccaacattccatgatatgactccatttcgtgaatcgtaccgggggtcgcgccatcggcatgaaaccagctttcgaaatgccgtcggtaagaacagttggcgcgaaaagcatagatgttataaccattcacctcgctggcccgcgaaacgacggaatggccgtgtggcgcgacgatcatcatctcttcctggtaagccggtataccttccagccccggatgcattagcgggccatcaataaaggcggcgttcagctttccttcgagcacgccatccagcatggcgccggaaggaccggtcgttaacgcgaactgaattttagggtaacgctggttataacccgccagcagcgcggggatacgtacggcggcagtactttctaacgcgccgagtgaaaacagtccttgcggttcctctccggcaaccaccatacgggcttcatcaaccagcgccaggatctgctggctgtaacgtaaaaagttatgcccggctggtgacagcctgagtcgctggttttcgcgaataaacagagagacgcccaggtcggcttcaagctggcggatacgcgtggtcagattggacggaacgcggtgcacttttgccgccgcctgcgtaatgctgcccgtcagagcgacagcgttaaacatttccagttgcgtcaggtccatggttttctcaattcgtgaatagtctggttaatattattcatttttcagaaagggtaaagggcgtcatgatggtacaactcccctgataacgagagaaagaacatgaccatgatgactgcaacacaggcgttatccgttaatcctgcgaccggccagacgctggcggcaatgccctgggctaacgcgcaagagattgaacatgcgctgagtctggcggcgagcggtttcaaaaagtggaaaatgacatcggtagcgcaacgggcgcaaacattacgcgatattggtcaggcgcttcgcgctcatgcagaagagatggcgcaatgtattacgcgtgaaatgggtaagcctataaagcaggcgcgtgcggaagtgacgaaatccgctgcgttatgtgactggtatgcggaacatggtccggcaatgctgaatcctgagcctacgctggtagaaaatcagcaggcggtgattgaataccgtccgctgggcgtcattctggcgataatgccgtggaattttcctttatggcaggtgttacgcggggcagtgccgatactgttggcggggaatagctacttgttaaaacatgcgcccaatgtcacgggttgcgcgcagatgatagcccgaatcttgacggaagccggtactcccgctggcgtctatggatgggtgaatgccaataatgagggcgtgagtcagatgattaacgatccgcgaatcgcggcggtgacggtgaccggtagcgtgcgcgccggcgcggcgattggcgctcaggctggggcggcgctgaaaaagtgcgtactggaactgggtggctcggatccgtttattgtactcaatgatgccgatctcgagctggcggtaaaagccgcggttgccggacgctatcaaaacaccggacaagtctgcgccgccgccaaacgttttattgtcgaagagggcattgcgcaggcgtttaacgatcgttttgtggcggctgccgcagcattaaagatgggggatcctctggttgaagagaatgatctggggccgatggcgcgctttgatttgcgtgatgaactccatcaacaggtgcaggcttccgtcgccgaaggcgcacggctactgttgggcggcgagaaaatcgccggggagggcaactattatgccgcgaccgttctggcggatgtcactcctgacatgacggcatttcgtcaggagctttttgggcctgttgccgccattaccgttgcaaaagatgcggagcacgccctcgcgctggcgaatgacagtgagtttggcctgtcggcgacgatctttaccgccgacgatacgctggccgcggagatggcggcgcgtcttgagtgcggtggggtattcattaatgggtacagcgccagcgatgcgcgtgtggcattcggcggggtgaagaaaagcggcttcggtcgcgagctttcgcactttggtttacacgaattttgtaatgtgcagaccgtctggaagaaccgcgtctaatcgccctgacgtcgcgtggcgccctctgctatactcgcaggccttttcagacctgcgagcaaggagcatgttgtggccagggccatggataatgcaattttagaaacgattttacagcgcgttcgccccctcattggccagggcaaagtagctgactatattccggcattagcgtccgtcgagggttcaaagctgggaatagcgatttgtaccgtggacgggcagcattatcaggcgggcgatgcgcacgaacgcttctctattcagtctatttcgaaagtgctcagtctggtgatggcgatgcgtcattatccggaagaggagatctggcagcgtgtcggaaaagatccttccggctcgccgttcaattcgttggttcagttagagatggaacaaggcatcccgcgtaatccatttattaatgcgggcgcgctggtggtatgcgacatgttgcaagggcggcttagcgcgccgcgtcagcggatgctggaagttgcgcgcgcgctttgcggcgtatcggatattacatatgacgctacggtcgcgcgctctgaatttgagcattccgcccgtaacgccgctattgcctggctgatgaaatcattcggtaattttcatcatgatgtgcctaccgtgttgcaaaattacttccactactgtgcgttgaaaatgagctgcatggaactggcgaggacgtttgtctttctggcgaatcagggcgaggcgtttcatctcgacgagccggtagttacccccatgcaggcccggcagattaatgcgctaatggcgaccagcggtatgtatcagaatgccggcgagtttgcctggcgggtgggattgcccgctaaatccggcgtgggcggcggtattgtcgccattgtgccgcatgaaatggcgattgccgtctggagtccggagctggatcctgcgggaaactctctggcaggtatcgccgcgcttgaacaattaacacaaacgttaggacgtttggtatactgatgaatgcgcttgaaccgctctttgcccgcctggcgcgatcgacatttcgttcgcgctttcgtctcgggataaaagaaagacaatattgctgggataaaggcgcggaggtgattgataaacacgccgccgattttatcgcccagcgactggtgccagctcacccggcgaatgatggtaagcaaacgccgatgcggggccatccggtatttatcgcgcaacatgcgacggcaacctgctgtcgcgggtgcctggcgaagtggcaccagattcctcagggagaaccgctgagtaaagcgcagcaacagtatattgtcagcgttattcattactggctggtcatacaaatgaatcagcggtagggtagcgcgtcgttgctgacgctttccccgataaatcaccctataccactgatagcagccgttgaccgtcatatatctcatgtgctgaaatgtctttttagttacaacatacatttggttgtttttttccaacgcctgtcagcaccatgcaaaaaaatgttctacagagcagggaatccgtgtatcaccagaagcttgcaaccttgatctggatcacgtttaatgacagtgctttttcacctgctgaagataatcatgatcgttagaccacaacagcactggattcgcctgatatttgtctggcatggttccgtgttatctaaaatcttttcacgactgctccttaactttcttctttctatcgccgttattatcatgctgccctggtacacaatgctgggtattaagtttacccttgcgccgtttagcatactgggcgtcgctatcgccatttttcttgggtttcgcaataatgcctgttatgcgcgttacgtcgaagcccgacatttgtgggggcagttgatgatcgcttcacgctcaatactgcgagaggtgaaaacaaccttgcctgatgaacgcggtatcgaggattttgttcggttacaaatcgcttttgcccactgtttgcgtatgacattgcgtcgacagcctcaaacgcaagttctgggaaactatcttgaccaggaggcgttacagaaagttgtcgcttcccattcccccgctaaccgtatcttattgctgatgggagagtggctggcgattcgccgccgcagcggaaagctttccgatattttatttcatagcctcaacaaccgcttaaatgatatgtcgtcagtgttggccggctgtgagcgcatcgccaacacgccggtgccttttgcctatacgttaattttgcatcgtacggtttatcttttctgcattatgttgccatttgcactggtggttgatctgcactatatgacgccgtttatttcggtgctgatttcttatacgtttatcgcgctggatgcgttagcggaagagttggaagatccgttcggtactgaaaataatgatttaccgctggatgcgatatgcaatgcgatagaaatcgatttactgcaaatgaatgatgaaagggatattccggcaaaacggataccggataagcgctatcaactgacctgagttcgtcttaactggcgcagaatgttcatctgcgccataacctgaaaagcaaagcttaatagccttctccaacgccggttttggctggaccggagtagtggacatgaacgattcgccatcctgtgtttggtatcttcgcccatacctggctttcgcggcctgtcgtgtgttgagtctgcccattatcacggcgtaccgcggtaaaatgccagtcgaactctgcaacggcggcattgccatacacatgaatagccgggggagcgtccagttttaacgtgcgtttgctgaacgttttacccatagtggtgccataaaaattttcagcgatctgcgaccatccgcgttcgtgaccgcgtggatgaataaaactggtttccggtgaaacataaaaaagctgcttgcctaacgttgggtctgccttatctattgaataaaggtaacggttaatgctttctgtaatttcttgtttaacggtcgacgtagcttcattttgtgcggcggttggcgttgccgctgatgccgatgacgccatcagagttaacgttatcgcggcggctgaaaaaaatagtgacgttttttgcataatagttatacccatatggtctgtttttgagacgctttatctttcctgttacgttcacctttatactaaaggagcatggctctcgaacaataaaaaacatccttctataaaactaccccgaaaagggagtagtgcaattaagaatatcgtatttgtttgtaacggcatgactcaaaatatcaacatttagagtttcagtattgttgttgtcccttgacttacttttatgtttattaccactggtaaatagttaatcttatgaatagtgatacacaaatgaccgtttgcgctatgtgataattaaccatagtaaaaatacgcgaagcgaagaagtgctatttcagtagtactgatattttcataacgctaatttaaaaataaatgtaaacgtaacaaattatacacaaaaataagaagggctgtggcctcaactgacttgattatgattccgtcttaatgaagtgtcagcagagtgttcagtgccattctcacctcggcatccccgaccgtaagccagttctctactggtcacccccttgttattacagcagaaaacagggcacaccattgatgtagccatgcttaacttgcattttaacatcactaatacatagcaagctaatattacactttgaaacttaacgcacggtaattgttagtgatattgtcccggacagttccgcgagcaggttttgcggaaagtccaaaaataagacaaataaggcatataaaatgaaaaaagtagtggtgttatctgcggtagccgcagccgtgatgatggctggagccgccaacgcagcagaaatctataacaaggatggcaataaactggatttgtatggcaaggtcgacggcctgcattatttttccagtaatcatagtacggatggcgatcaatcttatatccgtatgggtattaaaggcgagactcaaattaccgatcaactaaccggttttggacagtgggagtatcaggtcaacgccaatcgtccggaagatggtgactccagcggttccccgcaaagctggacgcgtctcggttttgctggtttggcatttgccgatatggggtctgttgattatggtcgtaactatggcgtgttatacgacattggttcatggactgacgtactgcctgaatttggtaatattacctgacgtcgtcagtctggcctgatgaactaaccatcctcgcgcggtttccactactgctattttccactcgccatcatcaaaacgattccagcgtagggtaggaagggcgctcaaacttcgggcgagcgtaatgcagcgggccagcagacgtagcgcagtcgtttttccgctaagacaacaggctgacagcagcggatattcgatagccagaggcgagacatccaggggaccatgggttattaacgtatggtccggggacgacgccatcggtagtgtaggtgtaatgatattctgtactgccgccagccagcgggcggtttcagaacgctcttgcaaaaaccaggcttcccagccctttacgccagcggcaagccaggtctgaggatcatcgtcaaaaaagattgtgcttgccagcggggataactctccgcgacgtaacaacgcccattcttcagcggttgcctgtcggtggctaaacagggggagccagtcggtcaacgcgcgacggagcgtttctcgcgccaactcttgttgtgcggcctgcatatctggcttctcttcaggaaacaacagtaaagccgccgctgcgttgtgcgcctgagcgcacaacgtaaacaaacgtgaaataagcgtttttgcgtataccggcgttgcgccctgtaacaaacgaccgatcggcgcctcctgccaggtaatccatagcgggtgagaatagacggtcaatctttgcacgaattattaccttcatcgatcaccataaacccggacttactggtttcgcaaaccggacagcaccagtaatcaggtaactggttgaagggcacgccgggtggaatttgccatacatcatcgcccagcgcagggtcgtaaacccaccaacatactttgcactccatgcgcaccactggctcattttctgtgaccgggtattctttcaaccattccaacgtattttttagccccgtgtaggcatcttcgatatcgtcgatgcctgcaacggcgatatcaggaatgtccgctatctcaatcatatcttgcagtaatgtgttcatatcattgaaataattgacccgccatacgccgggaaaatgcgtgcttacaatccggcatttaccatatccgcgtgaaaaaatagcgctacagccttcgcctaaaaaatgatccagatactcgcgatcggcatcgtttactggcaatagcgttaaattaatgatatgcggctcttttaccggctgttttacgcgctcggctatttcatgcgcgataaaggcgccattcatcaatcccgccagttgtggcggcaattctggtgtaatcggcggctgcggatgcgtctgccagatgctctccgggatcgggccaatgataatttcatcggcaacccgttgctggtcagcgttatattcacgtacacgccagacgcccgtaaaaaccgtctcctgaatacgctgttcttttccatcggataatagtacccgggcggagatttcaccttcgccgagcagttgatccaataaaccgctattctgttgctcagtggcattcagcttatagctcaggggaaaggggagcgttgccaccgggttatccatatcgcgaataagcgtagtcaggatgtgtctggcaacacggagctcagcgggcagcgcctgttccggtaaaaccggcgtcagcgggagattaatgccggcggggatgggaagaaagttaaagtcttcctcttctggctgcgatcctggtccggcaatattaacgactggaatagttctggaatgattcacgtgtgttacctttcattctattgcgtaataacgggaatatcctgacgatagcccggtgtagtcagcaatgcggccacccgctgagagtattcttgccagctatataatcccgccagactgccgacaaaacggtgctggcgaaagaaaagcagcgccggatatttcagaatgcgatactcccgggcgatcagttcactctgttcgctatccgcaaatgccgcggtataagatgtcgccggaaattgcttgaggatctccgggataatgacccaactgtcggcgacttccggatgtttgttggggtcactttgcagcaaaaccagcagagtcggatgcgcattaatcaacgacgggagcgtttgcgcatcggtaaccagaaagcctttatccgccagtggacaaacaggattttggggtgagatagtcatttttttaaatgctccggtaattcaggcgtgcgagacaataaatcggcaaaaccggtcagcggatcgctttgcgtgagcatggcctgttccagcgagtccagcgccaccagtacctcaacggcttccgcttcgtccatttctcgtcgcgctgcgccgccaaatgtcagcagccatgcgcctgctaaggggggagccacaagccgaatatcaacgtcgataagctcgccgtgtcggtcgcggcatttggcgaaccactgaccgggtgaaataacctgcacaggaacgccaatacacattatgatttctctctctgtagcacccgaatatcgccgacccggcaagcgctttgcgcatctggccgttcatcttcgtagcgttccatacacaggctgtaatgattgagtctttcagtgggcaaggccgctgaagaggcggtgataccccattgcgccagcacttcctgcgcgagatagaccgcaggcatcagttgcgcccttacctgcggcgtaagactcccgccatagtcatccagacattccggctgcacgccaatcagcacaatctccgataactggccgccggttaattgcagcaatgccagcacttcagaaaaactggtctgatgtaaactaagttttttcgccgtcagataggcgggaacctgttcatcacgaaacatcgccagcgaacctggcgccataccaaaatcgatagcatccatgattaacagtttttctgtctgttgcagccagggcagcagcgccagcccctgcgtaccgccatcaacaacgtcaactttctcgttatcggcatactgttcaaacagcttttccgcagctctgacgccgaacccttcatctgcccaaagcaggttgccaagccctaagattgttacttctgccattgttatcacctgaaccagcgccagccgcttatcatgacggaaatcacgctttgtcggctcataatgtcttcgcggatagcggtataaacatgcgcaatgacgaaggcgataatgaaccacatgcccagccggtgccagaaatgcagcgcgaggctatcgttgccagtcaggcgaatcatccagccaaaccattgatacgcccaactgtctgttccaagtccttcgccatagagcgcaaagccgctacacaccatcagtacggacatccagaaatagaacattaccgccagtcccgctaccggattatgtccatagtaacgatgggcctctttttcgaggaaaaaataccagcggatttcgctgataacgcctttgcgccaggcgcggcgccagaatggaaccagaaacatctccctggcgtactcattgccgacacatgcccagtaaatacgaaacagcagcgcgacagtaaaaatatacgccgtggtaaaatggatcagtcgtatccagcccatccaaaacataaaggtcgcttcaccttgaatcgatggcagggggcggccaatgaaatatcctgtaacagccaggacgacaatggataacgccgtgatccagtgccataaacggaccggcgcttcatagatatagtacccctggctggttatttctttgagatgcattgagacctccgaatcgtcgtcatcgtacctgaaccctgaccagctcccctccatgattatcaataacatgggtggagcaggccaggcagggatcgaagctgtgcagagtacgtaaaatcttcaatggttgatcgggaacggcgagtttagtccccattaacgctgcttcgtacgcgccaatttgacctttatcgtcacgtggcccggcattccaggttgtcggtaccacacactgatagctgtcgattttctgattttcaatttttatccagtgccccagcgcgccgcgcggcgcctcgctgaaaccaacgccttttgccgatgtgggccaggtatcgggttcccagagcgtaacgtttgccgtcgccgtatcgccggacttgaggttacgcattagacgatcgaagaaatattgcagcgtattgcctgcccatacggattccagcgcacgcgcggcagtacgccctaatgtagaaaagagcgcttctttaggcagctttaatacactaagcagttgatccactggttctttaaattccggtttattttgatgatatccaatcaaataacgcgccagcggacctacctccatcgcatgtcccttccagcgcggcgatttaatccatgaatatttggcggactcatccacctgttcgataaaggtttttgtgcctttatagtgttcgcccatgaccagttgcggttcggtcagaccatcccacggatgcaggcccttatcgttattgccgttaccataggtataccaggagtgagtgacaaactcctgaatctcatcgggggcggttaaatcgacaggatgaatttcgtcgaaacgaccgttaatgatagccccacgcggaagcagaagattactggcggaataatcgttagggttatccggaaactcgccataagccagcaggttcatgctcgataacccgccgccgatttttgcccagtctttgtaataactggcaatcagcaagacgtccggaagataaacttgttcgcagaactggcgagctttttggatgatggaactgacaaggttcaggcgctccatattcactgcgccgaccgcgcccgtttcgtcaaggttgatggcgcaaggaacgccgcccaccagccagttaggatgcgggtttttaccaccgaaaacggtgtgaatttttacgatctctttttgaaaatcgagcgcttcaagatagtgggcgaccgccagcaaattggcttccggtggaagtttcatcgccggatgtccccagtagccgttacggaaagggccaagttaaccggactcgataaaccgcttcagtcgattttgcaaatcgcggaaatatcccggcgaggatagcggccatgcggaaaggctttgcgcgatggcggaggtctgatgcgggtcggctttcagggcggcaactacatcgacccagtccagcgcatgcagatgataaaaatgcaccaggtgatcgtgaacgtgtagcgtagcctgcatcatattacggatacagtttgcgttgtccggaatcgcgattcccagcgcattttctacggcacggattgaggtcagcgcgtgtgtaccggtgcagacgccgcaaatgcgctcaacaaatgcccaggcgtctcgcggatcgcgacctttcaggataacctccaggccgcgccacatggtgccggtcgacacggcgttagtaatgacattattactgtcaatattcacttcgcagcgcatatgctcttcgatgcgagtaaccggatcgaccacaattcgccgtccgctattgtccagcgtaaaaccctgagtctgataaggatatgccataattattttttcttttccgtagcgttttctgatgacgtgttgtttttattgcgggcgtgttttatggcgctaaccgtggcgtgagcgatggcagcagcgcccgcgacgccggcaacgcccagtccgattttatcggcggtagcctcaatgccggtttgcggaatgcccgttgcccggctgtaaaaagaaccgtaatcccagaatccatcttccgaacatccgaggcatccatgacccgactggataggaaaagacacgccatcattccagcgaacggttgaacaggcgttataggtagtcgggcctttacagcccatcttgtacaggcaatacccttttctggcgccttcgtcatcccacgcttccacaaactgaccggcatcgaaatgcgcgcgtcggtaacatttgtcatgaattcgctggccataaaacattttgggtcgtccaagacgatcaaggggagggatgcgatcaaatgccagcatataggtgataacggcggacatcacttcaggtataggcggacagcctggcactttaataatggttttatcggtaattaatttgtgaaccggcgtggctttagttgggttgggacgggctgcctgcacgcagccccatgatgcgcaggacccccaggcgataatcgctttagcatccgcgctgacgcgttttaacttttccaggaacggctcgccagccagtatgcaaaacattccatcttcattcagcggcgcgttaccttccacggcaacgatataatttcctttgtactcacgcatcacatccgccaacgcctgctcggcttgttgccctgcggcggccataatggtgtcgtcataatccagggaaatgagcgacaaaatggcatcttttgccaacgggtgcgcagagcgaatgaaagattcggtacagcaggtacattcaagaccatgcagccatatcactggcgtacgcggtttattctccagggcataagctatctgaggaatcatcgaactgctcaggcctaaagacgttgcggtaaggctgcaaaacttgaggaagctacgccttgtcacgccgtgtctacgcataacttgataaaatgtatcttgtgtttgcataacgtttatcccaaaccactatagttagtgtgggcatcatatgttgcatttcttgtctttctcaacgtgttttagtagcaattatgtttctaattcgtaacaactgattacatgtgtgctactcacattactcaaaaacataaattaatttaatgttattggtgatgtggagtaaatatagcgttgtgaagatatctcttaatgttgataagaaaccgtgttttttatttataacatgatgggatttttttaaatggtcacacggataacgcgtttcatgttagttcgctgtgtttaactctcctttaaacccgtcagttaaatttattagcttgtaaaataagatcacaattaattacgtgctgcataaccattgataggtttaatttaatatattcatccaatccattttacaaacaaggagagcatgatgaaaaaaagtaaagcaatgttatttatcgctccggcgctgttttcatacgccatggctgcacaggcctgcacaacccttgctattcaggataaacaaggcgatatttttcatgggcgtacgctggaatatatgcaggatttaccctcatggttaacgtattatccggcgggaacgcagtttgataaaaaaacgccggatggcagccaggggataagctatcaggcgaagtatccgatactggccattacttccaccattactgatggcgatagcagagacatacttgaaggcatgaatagcgcgggattgtcatttagtgaaaacatgatcatgaatgcgcagttgccgccattgcccgcgagtgaatataaacaggcaattcctgtcacctcgttgggagaatgggcgctggcccgttttgctactgtcggcgaggtaaaacaggcaataaaagagggcaaattctggtcaccggaactgcatcggtttggcgatctgaaatcgccatttcattacgcgttttacgacaagaaaggaggaagcattgtcgttgaagtggaaaatggcaaattccatgtctatgacaatcccactcgcgtgatgacaaatggtcccgcattcccctggcatctgacaaatctgaataattatacgcaattaaccaatgtggaccgctcttcaggcacattgggcgggataaaagtgatgcagcctgatagcgggattgctattgcagacttgccatcgtccgatacgtcggtttcccgttttatacgcggcgtttattacaccacatatgcgccgcaagcgacatccgcccacgacgcaatgaatacgcttgcacatattatgagccgttttgatcgtccgaaaaatattacggttgattatatggggagtgaaggggaaggcaacgccacccgcaaaccggtctcagaatatacggtctggacaacgctgtctgacttgacgcacggtgagatgatggtgcgcggctacaatgatatcaactataaaacctggtccctttctcagtttaagaacgcgactgcgcccgtgttcgagaaaatcaacgtcaaaggataaaccgctcgtctctgtttagtttccccggtagtctcggcgaaggtaatggagactaccggcggttgcttctctttatcatgcacggtaattaattatcacgatcaccagcgccaggatggtatgctaaatccattcaaaatcccctggatatggattggagggcgcatggttatacctgaggtcaggcaggagaggctctatcagaagatagccaacctcatcattaagctgatcaatgataatatttttccaccgggaacttttttaccgccagaacgcgaactggcaaaacagcttggcgtgagccgcgcctccttgcgagaagcccttattgtactggagatctccggatggatcgtgattcagtccggtaatggggttatcgtttcagataaaaaacaccttgccagtgactataccatcgaagaaattctctctactcgcgagctggtcgatagccattgtgcgcgcttagccgcacaaaacgataacgttgacgtcatcaaccaaatagaggcgatttatcatcgtatggatcaagccattaacgataataacgtccacggcttttactcgctggataaagagtttcaccttgcgatctctgaggccagccgtaaccgggtgttgtttgatatgtcccgtatgttatgggaacaacggattaatatcccttacgccgggcttgatgaacagtctggagacagaaatgttttacttaatctcaacaaacaacataaagcgatagtggatgcgatgcgccagtctgatgctgacagcgcttatgagggatcgctggaacatttacgctatgtgagaaagattgtcggcggctaagtttgtcggtaaataacaccgcatggcggatatgccatgcggtagaactcgccgtaaatcaatggaaaacagcattaatctttaagtaacgctccggatagcgatcaagttctttaactgcatcagggatctcatcaagattgacgaccttactgacaacatcttgcggattaatctccagcgttgacagcatgcgtaatgcctcatcaaattcaccggcactggtgcgggagccgcgtaaatccagttctttgtaggtgatcaggttcgtcggcagcgacgtttcctgttttggccatccggtaaacgaaatacgaccagcaaacgatgctaaatcaagcgtatttcgaatagcgctatttgcgccggaggcttctatcacgacctgcgccatggtgccgtgggtgatatttttaatagcgtcgataacctgatcgtcagcggcgttcagtacataaggaacgccaagcttttgcgcatagcgtagcctttcttccacaatatcgatcagaataggcgttgccttgtaatgacgcgcgcttaatgccgccataagaccaatggcccccgcgccgatgatggcaacatattccccggccttaacgtttgcccgatgcagcgcgtgtagagcgatggtcagcggttctgccagcggcgccatttcagaaggcacattatctggtattttatgaattaaatgtgcgggatgagtaaccacctcctgcattgcgccatcgatatgcacgccaatgacatttaaattttcacaacaattagttctgccgacagagcaagggtagcagtgaccacaataaatataggggtcaacaatcacgcggtcgccttttttaatattgtccggcattccggtgccttcctgaagaacaattccggtcacttcatgcccaataattcttgggtaagtaacaagtgggttcgttccacgaaaagccccgatatccgatccgcaaatgcctgcggcatcaaccttaattaatacttcattttctttcttatggggataatccacccagcgggtttcaacttcaccaggcttattaatgaacacagctttgactttcattggctttgaatcctttactttttacaaacacgaagaccaacaggcttgaaacgatagcgatagcaccagccagatagaacgcatagtcatatttaccgctaaattgaacgataaaaccggtgacaagcggaccgataataccggatatattagccaggccatgcatggctccgccgacgctccctaccttatctttatgaacaacatcctgaataaccgcccaataaattgggcctgttaaatagagcaggaagagtgaaactgacatgagcgtaattgcgctaccaatagtgctaacggtaccggaaacggcaacacataccgccgcgcctgccagacatacgcccagaataagtcgacgtgagagcagggcattaccggtaatccgataaattacatcagaacagacgccgccgagcaccataccaatggcgccgatgacccagggaattaccgtggcgatactaatttctttaatatcgagatgtaacgaatggttcagataacttgggaaccaggtcaggaagaaaaaaagaatatagttgtagctgaaaaaagccagagttgtcgcccataccattggttgtttcatgtaatagccgagtgaaggcgtagcccggccatcatcagataaaataacgtcctcatgattttcaaaatcaatgcgttcttccggcgccaggcgtttactcattgttggcttatcgctaacgataaagtaccacagtagtacccagaccaagccaaataagaaaataatgccaaatgcggggcgccagcctaaggataacgccaacaggcccacaatcggcccggacaccgcgccgccgagcggggaaccggcgctaaaaattccgatcgccgtggcagactcctttcgggaaatccagttattgatgattttatttccggcagcgctgaccggtccttcagccataccgaaaagaacgcgcacgataagcattgtccacaatccggtgactaaaccagttaagccacaaaatacagaccatagtaacgctgcgatgagaaaaaccgtttttggcccaactttatcgctggcccagccatcaataaaattaaacagggcgtatccgataaaaaatgcgctgaagatcattcccatctccgcggcgttaaatcctaactccttttcgatcaagggggcagttatcgacaatgctgaacgatccatatagttgagcatgtaaactataaatagaagaaaaacgataagccatcccattgtttttcttttcatgattaatcctcttattgtggtctagcggcctgaccacaatattttaaggttattttcaaatcacctatcttgtggttagaacgtgatcaatataacaaaaatttatcgcagaggatttttatccatcgcaagcgtgatggataaaattatttaaaatcagacaattacttgaaaattcaatcggggctatcgttttcccctaatccacgccccggtaacgtttgacatgcggcgttaacggaaggtggtgctgtctgtgggtatttttcatcgggcgtaatataaacctgactcgtggcgacatagccatcattaaaagtggcttcgatataggtagcttcccaacctgtcttcggttcatttaacgtaatactgatcttattgttggcgggaatatctattgtaagcggctgatagcggatgccacaggcataacggaaatcacgcgcatttggattgttggctgtccagcgaacgacttttaccggcgcttctgagaaatagaccgtaagaagatggtggtgaataaggccgatcaactgcggtaatgtttttttactttgaaaccggttaataaatggaacgaggcttccttcagcgaactggttaattgagtagtggttcatattaggcactatacgtaatgattttacgccaggaagtttgctataataaaagcgagtattgtctggtacgaagaaatcatcgccacttgcattaataatatatttcggtattgcaaggcggggttggtaaatagtattgagatatcttaacggatctattatttgccttagctgggtaaatgtgggggattttattttctcatctatgccttgctggtagtaggggtagaatgtaatgggccaatttccaccgtatgattgataaatatgctcaagtgaagcatcaatatcaagtagatcaatggcgaagggaacaattgcttcaacatcaggatcggcaatagctgacaaccaggtggtccacccacgctttgaaatacctgtaatgataaaggaatttatattccattgcgttaactccttttttgctaatctcatcgcttgcgatatggcagtgaccataggaatatttaaaggcattaactcacgttgctccggcgcttccataaataatgcccagcttcgggaaacgctctcgtcctctttcagtggttttttatcatcctgaaaggttaaatattggttaggtatatcactcactgatattacgatggtattcgtatcacgggcgatgcttgccagtgtttgctgagtaaaatcaacgggtttactggggatttgtatgcctttttcataattaattccgttgtttacaaccaccaaagcatggtgctcttttgccgtttcagggatataaatatcaacgttatgtcgccattgcgcaggggttaccatgtcatctggcgaccagtgttgcgataataattcatagtgtctgactaccacctgtgctaatggagctgtactaattaaggtatattttagcggtgtgcctgaaatctgctcccggtagtcggggagaacatgagacaaatcacactccgggctgtttcgacaaaagaagatgttgttatgaagtagtgtataaacttttgtagaaataaaaaacagtacgataacaacgagatatatttttttcatgctttccccgcgctttacaagggcaaatgccaaccagcataatttccataaatacctcttaaacattcaatataagtacaatacttttgataaataagggaagaagggagtaataatgcttgtgacgttgtcacattattctgtttctggtttcgctattagcggtgaactttttgaaaggtaaatcattgccgtcaccagaccaataatggcgacagagatagctataccgatccagacgccatacagggcataacccaggacaaatccgcccaatacgggggatataaaatcagcgattgcgattaatgcctgcgccgttccgatgacgataccttgtcgggcaggcgatacatggacggacaaggcggcaagataagtgggtttggctagcgcatcagcgatgctaatacaaacgatagcaaaaataagcactggtatggtcgtggcgatacccgcagtgagaaatccagtacaaagaagggcgaagatgaggataattagctttcgctccgaaaaatattggctcacccaacctaacagaaatagctgaacgaaaatattaataaccccgtccgccattaacagatagcttaacgcttttggcccaaagggaagcccattccagatgaaggtgtcagaaagaaaaacaggtaattgtgaagagtacatgccataggcgaagaaatgacaaagcattacgatgattaagacgcgaaggactggcatctttaaaatagcgcgggcagagaacgacgctattttatctgtggtacgtgatgttgtggaagggtcttttaacccccaaatcgcgaccagggcagccccaaggacaagtataaaggcggcgtagatcggcgcacccagactgatacgcgatagccacccggaaacgcctgccccgacaataccgcctaaaccaatgcagcctgtgaggataccgattgcctggcgccgatttctgacgtgcgtacaatcggcaatataggctgcggcggctgacaaattcccggcgctaatgccaaaaagcgtgcgggcgagcaggataaacaggatacattgcgcgttggcgagtaatagtaaacttatcgccgcaatagccagcgtgacaatcagtattcgcttgcggccaacgcgatcggaaaggtggccaatcaggggcgctgcacaaaattggctaaaagcctcagtggcgatgatgattccaatgataagcggcgaaccgcccatctcgcggatataaaaaggcagtaccgacatcacagccgctgtactggcggcgtaaaggccgacaagcaggaaaacaggcaaaatacgccgcttgttgagcggggtgatagtttcgctgtcggtgttctcatagacattagtattcatctttaatccctatggcaaaacgagagagataattttcaatatcgttgctctgtttgccgtgaaagaatgcgccgacatagccatcgggtcggatcagcacgcattgacccggggccagatgataggactcccggaagtgccccagggtatcgatgagctcgtcctgctcgccaatgtgatgaatacgcagacctcgccgcgcatcgatgaccttaccgtgggtttcgtaggccaacagattccagtccggaccctggagtaactgaaataatcgtaatgattggccgccggcgcccaaaagaggagcatccggagctctttctcccgcttgtaacccatgctgacgttcgggcaacgtgtgggctaagggggagttggtatactggatgtcaagttgttgaacgtcgcgttctcgtttgatgccaccctgtttttgagagtcaagtaatcgggtagaaaggtggagcagtgattcggctaccgggcggcgttcctgttcatagctatcgagaagctcttctcctgcgccccgtagcgaggctgccattttccatccctggtaagtgaagcgtcagccacaagcgcatggattcccaacgtacggccggggaagctgacgcctaatttctttctgacaaagcttccgccgccatccgcgcctatcaaataatgcgcgatgatgacctcttctccagttggcccggcaacatacgcggtgaccgtgcgtggggtttgcgcaaaatgtcgtaactcgcagccgaactccacccgatgtccccatgcttttaattgctcccgcataatcgtttctgtcacgttctgtggaaccatcaatggcagatggtagggttcggcgtgggtcggttttgtattatgcgcaatatctgaatctacgtagcttccgtcatgacggtaggttcgtaatcggggatagagcccgccggcggcgaccactttattgagtatcccaatatcctcgaagatttcttgcgttcgcggctgaatacctttatcgcgggaaccggtaaaaggcgtcgctcttttctcaatcaggcgaaatgagaccccgtgacgcgccagttcgatggctaaagtaagcccggtaacgccagcgccgcagatcagtacatctgtagtggtgtatgttgtcatcgtctctccaatatgtgtattatgcacataagaggagacatgctatgtcagaaaataaaaatgtgcaagatacacatatttccgagcaaatgaaggcacttcacggtgcgttgattcgcgtggtgagcgcgctcaaccggcctcgtaatgatgagaaattaattgcagaggcggggattcaactcgatcgcgcgctattttcgatccttattagtatcgaacgtttagggccgattggcgttgttgagttagccgaacgtgccggtcgtgattatacgacggtaagccgacaggtcgccaaactggagaagttgggattgataatacggcaacataatgtcatcgatcgtcgtatacgcgaggccgttatctcccggacaggaaaggcgatgacggagcgtatagacgctgcgcgagagcaaatgggcaacgttgtttttaaagactggcctcaggataaaattgatatctttgttcggttaatgcaaaagtttgccgatgcaatggatagcgatgcttcaatgccggaataagcaaaagaaaagggcggtcaaatctgatcgtccatgctactgcattaattaaatagccagcaaagtaaatataataacaacatttatcgagttaattttcaccctttgaaaggccaacgtatactgcagaatacggctatataacaatcgccgtatcaatggtttttcaaagggtaaatatatgcttaccgaaaaatatgattttcgcattaccgatcagatgactatcccactcagacctcattggatagccaatgattcatacagggaaaagtgcaaaatgcttgtcctcaaccgaagtaaaggggaaattcataaggtagactttagtaaagtaacagattatatcaaagaaggtgatgtaatctgttttaacgacagtactataataaaccatatgtttatctgtaaaacaagacgaaatagattaattaaaattgttttagagggatttttactaaataatagagtaattatttccggacttttaaaagaaaggcttaacgcgaatgatgttttctatttggttgataaccctgaaatttccattaagatagagcaaaggtttggcgaggagagccagtaccgggccgttgtagaaaatcatgaggctttaatttgctatttagccagtcatggtgagcgtcttgatgagtatgtggactccagcttgttttataaatatccagatgcttaccgttccgttttttctaaaaagtatggctctttggaaataccttctgccggcattcattttacctgggatcttatccaaaaaatcaaagataaaggtgggttaatatcttttattactttacatgttgcatcaacagaaatgttgtccaacagaaaaatacaaacaaaatgtgtagaggaagtgactatcaacgaagaatactacgaggttccacaagctacagcggatatcattaatactgcgaagcaaaatggcggacgtatttttgccgtaggaactaccgttacacgatgcctggagtccgcgtattcgagggaacacaattgcctcaaagcaagttctggctggactgcgctttatatacatccaggctatcaactgaaagtggttgactgcctgctaacgaacttacatcagccaaaaacgacgcatatggtgttaactggtcagtttgctggggttgatctactcatgaaggcctatgcctcagaagatatccagtcatgtcagttcgatatgtttggtgattgcatgttaatcatacaggatgaagggcagggatgaataaaataaaaccggtacacataatgctaccggttttaccgagaataagcatcaggggattcgggcaataacctttatttcgaaatcaaagccggccagccaggtaacgccaacagcggtccagttaggataagggggataggcaaatatctcctgtttcaccgccatcacgtcgttaagttgtagacggcatcattttcacgctttccaacaccaatgacagttaccgtgataatttcatcttcgacgctgtagaccagtctgtatcctgcaccacacggcttaattttgtacttaactgcttgtatcgattaccaggaacgttaacagcgtgcgcaccagcttgccattgtctaattcaagcacacgacgaacaaatgtgttataacaatcctataaagtggttgcattgccaatgcataaagttaatttaatcaggaaattagagtatggatacagttgaagagcttaatagcacttatttttatgccggacgttcaaatctgactgctagtcagttgctgtttatgattttctgcgaaaacactgccaatcagttgggtgttcaggattttggggcgatagtgtctattgtggctggattgaatgttttgcctacgcggacaaaaccgcgtggtgctaagcatttgcttaatccgtttcgcaaaaacgatattcctcaggcgccggagttcacgataggtatgctcattgcgtctgccagggctggtcgctggttgtatgactgattcacgcttgggggctgctttccgttctccatcatcatggagcgcataatgtatattatgttaaatgcaccagaacaattaaaagacatgttaaggcggctggattcgtgcatgtcaaaaaacttctggcccataagtttgatcccttccctgccgtgacgctgcgcgaattctgttgatttgcacccgcttatcctgcacacgttttccttgcaagtcatgccttgagattcttagttcatgccttaaggattccagttgacctctttctctaatcttttttaattccagatcggaaagcgcagtaaggaattttacttccgcggctgatagtcccattgtaatcgcttgctcttcagaagaaagaggatttaatttaccataatccttgaccaactgctccgtagtccattcatgtaaaaacatatggttactataaataaccggatcaatacctaatagtgttgccgataattgagttgatcgctgtgcataaattgcaccttcaaccttacccagtaaggttcctatagctgacggcagatcgtaatccagaagatctacctctcttgttgtaaaactctttaaatctgtatcgtaaacccagacctctttttcgatgttattgaaattatcaagcaatgtttttaataattctttatttattaggatcttctggaatgtttcttcatttctcccaaagtgctcaagaaacgctaaataagtagcgtaatccatttttctatctttaaaaaagagctgacttagaaaagcggcagattgttcatgattgcgttctttatcaaaatccagtaattcaggaacgattagaaaaattggataatcatcatcaatagtcataaatgggatggcgcgaaatagattggaaacatgttcaagtaataccaatctgcgcatgcggacataactattatctggtggcaatgacaaaaatgaatgcagagagctaagagaaggaaaatgtaatggatcaaccattatgatgctatcaaaataaatccccagagatctaagatgattagatatgttataaccaaaccgttgaatcggaagtaataatcgataacttttagacgcccgcacttctgttataagcgccgcggcgtgagtatcccaaaatttatttagcaacacgattaggtttgtaagttgattatctaactcgggagagctaattagctctttcagaatgaatctacgtaattctttcagttctaaatttctaaatgcatatttatatttttcagaaaaagcgttttccatcaataaaacatattcattctgtatgctttttgtaatactactaccttactgaccggagctccattatgagtgcatcacaaaacaagaagaaaacgctgtcattgggtttagcgctaatcccagtcatctccatgttgttattgttgattatcggttacggcatcatggggctacgtatctattttgattgcagccttctttttaaccagcgtggtctccgtctgtaccggtacatcgtgggggtccgccgggacggttggcgttgcgttaatgggggttgccgccgggctggacgtgtcgcttgcagcagcagctggcgccgttgtttctggcgcttatttcggcgacaaaatctcaccgttgtccgactcgactaactttgccgcgattgtcgcagacactactctgtttgagcatattcagcatttactttggacgaccctgccaagtttcctgcttgccgccgtggtttatcttatcgccggacacagtaatatgctgggcgaggtggctacgccgcagcgcgttacggacatcatccactcgctggagtcgctataccattttaatattgttcttattttgccgccggtgatcgtactgtggggcgcaattcgcaaaaagcctgtcatcccattaatgttaagcgcctgcgtacttgccttgttcctcggcgtcatcatgcagggactgagcatcaaacagggactggacgctttcattgatggatttgatatcgccatgttcccacaaggcgcagaaggtgtgcaacaatactggttcggtaaagtgggattttattgagcgtcactttggcgacggcgctggaaaactgctgccgatgtgggtttctgatttcgattttgcctgcccgccagaggttcaggcggcattgcatcagcgaatcgagcacggcgtatttggctatagcgaacgtgatgaggcctattttaacgccctgcttcactggttttcgtcacgccaccagctcacgttaaaacaggaatgggtatgcagcgtggaaggcgtcgtaccagggttggcgctcttagtgcaaatgttgacgcatccaggcgacggcgtagtggttcaggggccatactatggctccttcgccaaaataatcacgcttaatggtagaaaactgctggagaatccccttagcgagtcgccggatgaaggctaccagatggatttttgccaactggaaaggctgtttcgccatgagcgccctccgctaatgattttgtgtaatccacataatccaaccgggcgttgctggtcggccaacgagctggagcaactgcttttattatgtgaagcttatgatgtcactctcatctcggatgaaatatgggccgatctattgctgccctgcgaaacctttacctcggtactgcatttaggggagcgctggcataaacgggtcatctccgccactgcggccagcaaaacgtttggcttatcgtcgttgcgaatttctaattttctcattcccgatcctacgcttcgccagcgtttcctgtctcgtctggacgctcatgggctggatgtctttaacgccctctccgttcaggcggcaactaccgcatggaatgaaagcagacagtggctggattcgctactggattatctggcggaaaaccgccgctggtttgttgaacaggcgacagagcaccttccctgggcaagaattgtcccggcgcagggaacctatttattatggatggattgtaaaaaactgggactggatgacgaacagctaaaatgggtaatggcggatgtcgcgggtattgctccttcaatgggcagcggctttggcccggcgggcagcggatttatccgtttaaatctgggatgtccacgtacctaccttgaaatggcaatagacggcctgaagcgaatatcggtgaagacaatcaaaggaataccaacaggcggatgaatttttcgggcggtaaactgacaacggtgttatttctgcggcatgatatcgcctgagcgccagtaaaaaaccggccattaaggccggttgggtccggagcgcagtttcactatcaggggcgtctgaataacacgatgctgcgcccggccagatcgaaatccatttcttcggtaatccgcattccctgctgcgcgtcatcggcagtcgtcagttcaagcacccagccgccttctccccacatcggaatacggaacggtacgctgccttcaaacggattgaaaagcagtaaggcgtcatgccagatccccgcttccggctgaagatcgggtcgactaatacatacgcctatcgtcgatccctcatcccattgttcggattactgcgcccctccgccggcgttaaaccagcggatctccagaccgtcacgccagctctcccggcgcagcaacggttgcgtggcgcgcagttgaatcagatgacgggtaaactcccgtagcgcattggcggtttccggcaaattatcccagtggacccacgatatttcactgtcctgacagtagccattgttattgcccatctgactgcggccaaactcatcgcccgctaataacatcggcgtgccgtgtgagaaaagtaaggtggtcaggaaattacgtttctgtcgctcgcgtatcgcattgatgccctcgtcgtcggttggcccttctgcgccatagttacaggagcggttatcattatgcccgtcattattatcttcgccattggcttcattatgtttgtcgttataagacaccagatcgttcagcgtgaagccgtcatgggcagtaataaagttaacgcttgaccaggagcgacggccgcgcaaatcgtagagatcgccggaacccagcaggcgtgcggcgaaatcatttgtgacgttgtcacctttccagtattcgcgaaccgtatcgcgatatttatcattccattcgccccaccctggtggaaaaccgccaacctgatagccgcccggtccgatatcccagggttcgccaatcagtttcagttttgccagcaccgggtcttgcgttaccgcatcaaaaaagccgcctctctgatcaaagccttccggctcacgaccaagaatggtgcccaaatcaaaacgaaagccgtcgacatgcattgactccgcccaatagcgaagcgaatccatcaccatttgcagtacccgtggatgagaggtattgacggtattacctgtccctgtatcgttaatataatagcgatgctgatcgggcatggtgcgatagtaagagaagttatcgatacctttaaatgacagcgtggggccaagttcattcccttctgccgtatggttatagaccacatccagtatcacttcgacgccggcatcatggaaagcgcgcaccatatcgcggaatccctgaataccttttggaccatagtagcgcgtcgccggcgcaaaaaagcccagcgagttatatccccagaaatttttcagtcctttatcgagcagatgctgatcgtccgggaaccagtgaacgggtaaaagctcgacggaggtaatccccagacttttaatgtaatccacgctggctttatgccccatgccctcaaacgtaccgcgtagaggctcagggatcgccgaattaagctgggtaaagccttttacatgcgtttcataaataatggcgttcgaccacggtatggaaggccgttgtctatcctcccagttagcctcagccggatcaatcacccgacatttaggcgtaaatggcgcgctatcctggtcatcaaaggtcaaatctttatcgtcatgaagtaattgatacgcgaaatgcgcatcgttccactgaatatcgcccaccagctcacgggcataagggtcaataagcagcttattggggttaaaacgatgaccattttccgggtcataaggaccgtaaacgcggtacccatacagcgcgccgggctgcaacttcgtgacatagccgtgccatatttcgtcggtatattccggtaactccagacgagcgatttcatgctccccactcggatcgtaaagacaaagctcgacgcgttccgcatgggcggaaaaaatagcgaaattcacgccttcgccgtcataattcgcgccaagcgtatggctgtatcctgatctgatttcaaaagccctgtttgttgtcattctctttctccacccacggtaaacgttgtcctgtcacggcacatcaacacataaactcagtcgctcattaaaaccagtacgccgccctgatgtgaggccaacgacaggcgttcaccaggcattaacctctcctgggtaagcacattgcgataacgacgctgattaagctgtccgggtataataatgtcggttcctgaccagaaaccgctatgcgattgtgataataagccgtcacattcggcgaacaccagtcggggcgcaacaacaatcagcgcatcatcatgattgactctggcgtaagcgatgaccttgtcggcacgctgaccaacagcccgcagcggtatatagtcgccaaaacggaagagctcatgattctgctgacgcaaacgcagtaaggcggcggtggcatactgattcacctgcccgtccagccaactctcttcgcgcgagaaaactcccggcgtcagttggtctaactgctgcgccagcgtggcgaaatctggttcgcggcggttgtcgggatcgacaaggctaaaattcaacgcctcgctcccctgatagatatcaggtactcccggcgcggttaatttgataacggtctgcgtcaggctgttaaccagtcctgcgcggatgaagggttgcaaggaacgataaaaatcctgcaaaaatgtctgattatccggcgccagtaaataacgggcgtaatcaagcattgccgtttcgtaagcctcattactgtccacccaatcggtacgtagcttcgcttcgcgtagcgctttctccacaaaggcttcaaagcgtattttcagcgcgtttaaacctgtttcgtcctgtggttgtagcatcgggggccagacgccggtcagcgcctgatatagcatccacgtatccgccgattttggcgcagtgccatcattcaaaaatttgacatgggtctggttcatctgccgccagcgggcaaggcattcgctccactgttccggcgcttcggtaagcgtatacaggcgtgctcgcgcatcctcgcctcgcttggtatcgtgggtcgacgtaccggataacgcatcaggctgtcgcgcctgtcgggttttcatctcatggtgaaagcgttcgatggagaagtgatgcgtgacgggctcggcgccgacttcatttaacgccagtcccatgttttgacgaaagaaaagcgtatcctctaccgatttcgccatcagcggaccggtgagttgctggaaccgaacgcgaaactgtgtcgcctcctcctggctggagacgggaacatcgccggtaagaagacggctcagaaatgtaagcgcttctggctgcggagggttttcaagcgtctttacccgttccacaatacggtgtaacaggcaaatatcggtcggcggtagcccttctgccgtgccgtaagtgcgatatacgggaaaggcaattaataactcgcgtaacgcctgccgaacgacgctctcttcctgtgcgatctgtagctcgctggcaatcgacagcgcaagcgcgagcagccgggtaaattccccctcaaaattgcgatcgaccatcagcaatttagccgcccgtaattccgcccgcatatccactggcgcgcctgttacggtctcgtaagcctggcgcagattgtctatctgcttatcgtcaaccagtacttccgccagcgaggcgatgaattcatagcctgtggtgccggaaaccggccagtcatcaggaagttgctcgcctttagcgagaattttttccacggtgatatagcacgccggtcccacttcctgacgtaaacgcgcaagataggctttcggatcggcaaggccgtcgatatgatcgatacgtaaaccgtcaaccgcccccgttctgaccagctccagaatcagccgatgtgtatcgtcgaagacgattttatcttccacccgcattcccaccagccctgtgacctcaaagaaacgccgatatgaaagcgagcgagcggcatcgcgccaagacattaatttccacggctggcgctcatgcaaatcagcaatagcggctttatcggtaagcgccagtatttcagcctcgcgcccctgccacgtcgctggcgcaagcggataataattatcataataggcgaacgtgggtttacccgtaacgggatccggcttgatcgcaatttctccgtttcccagcacggcgtcaaacgtgtcgcctaaaaaaggcagcgtcagtcggcgcgaccagtcaatatcgaaatggcgcgcgtaacggctctccttgccatattcaagcacgtcgcgccaccaggcgttttccagcgagctggccatgtgattaggcacaatatcgatgatcaatcccagaccttgtgctttaagttcagccaccagtctttcaaatccttcgcgcccgccaatagaaggctcaatctcattcgcatcggtgacatcataaccatgcgttgacgctttggtggcggtaaagatgggtgaggcataaagatggctgatacccagatttttaaggtaaggcaccagcgccgcagcgcgatcgaaggtcatgctattgcgaaactgaagacgatacgttgcagttgggatcatgatgcagactctccctgggctaagcggacaataagagaatgttgggaaagcgacccggtggattcattcggccaggcgaagagagtcttacccggtaaatcgggcagcaataccgtcgtggcgctaatattcagcgccagtgacagtgttcctcccggaaaacgccagctaacggcaataaacccgggcgcggtttgcaataccgttcctgagctctcacgggcagcggacaacagcggcacgatatgcttctggcgcaaaagcagtagttcgcgggtaaatgccagccacgctttaccctcttcactgtgctgttgcttccagttaagttttgagcgttgaaaggtctctggcgcattcgggtccggaacattttcccctgcatgatcggcaaactcttttgcgcgaccttcacgaacggcgcgggctaaatccccatggaaatcggtaaaaaaaagaaaaggacggctttcgccatactcttcgcccataaaaagcagaggaatatgcggtgaaagcagcaacgtggcgagcaatacttttgttcgttcagcacccgccagggttatcagtctgtcgccctgggcgcggttaccgacctgatcgtggttctgaataaaatccacaaaggcgaccgggggttgtccggtactttttacgccgcgaggttcgccggtttgcggtgagatttccccctgataagcgaatccttcggccagcgctcttgcgaggtgtttttccggggcatcagcaaaatcgttgtagtaggcctgggtctctccggtcgcaaaaacgtggacggcattatgaaaatcgtcattccattcggcggtaaacagcggcgcattgccatcctgatcacggggatgcagagaaataatattgcggctatcttcggtagtcagatgaatgggtctgtcggtaatgtcttcccgaatacgttgtgcgatttcaaccagcacatgcctggcgctactgtcctcaatctgatcgatagcgtcaaagcgtaagccgtcgagatggtattctgtcagccagtataacggcgcctcgatgatatagcgccgcacggcgtcgacatcataggcgataccatttccccacggcgtcatgcgctctttgtggaaaaacgccggcgccaatagcggtaaataatttccctccgggccgaaatggttcagcacaatatccaggatgacggaaagaccatacccatgcgcggtgtcaataaacgctttgaaatcatccggcgtcccataggcagaatgcggcgcgtaaagcagtacgccgtcatagccccagccgcgctcgccgccaaattgcgcaacgggcatcacttcaataacggtaacgccgagttcagcgagataaggcagcttcgctattgcggtgtggaaggtgccttccggagtgaacgtgcctgtatgcatctcgtacaccacggcctgctcccaacggctgcctttccacccggtgttgcgccacgcgtagctgcctggatcaatcacatatgacggaccattgacgtcagttttttgggcgcgggaagccggatcggggagcaccatgccatcgctgagtacaaagttatactccgtacctggcgtcaccccggatacatccagcgtaaaccagccgtcaccgctcgcctgcatttcctggtctttacccgcaagcctgagcataaccttttgctgaccggtggcccaaagacgaaagcggacgacatcagcggcgatatattcagccccccagcttttgcaaaaaatttttgaactcatttgtcgctccgtttaactcataacctctacagcatccgaaaaacaagcatagactatggggctaatttttacgtgacactgtcacttaacaggcattctttttcctatctgcgtgtaaaaccgtggaattattgtcgggattgctcagatataccgaagtgcgcggtatcgcctcgcccgtgttcgccagagccctgaacacgctgtagctggataacttctccctgctcccaggcgttagcccccttgataacgggatgttcaggcagatcctgccgctcgcgtttaatggcctgggtatcaatccccagacggcgatcccgatcggccagcagcgcggggtcaagctgcccgtcgccggtaaagcccatcatcagcgcagggatacccattggcagggttttatcccggtcggtatgccaggtgtgccaggtcttgccataagtattaacaatcttactcatcaacgccttatcagcgacctgcggtaagcctggcgccaccaggctaccggatttcacctcgtactggtggctgtgccacagttttttttcctcgggaggaagcgttttaaataaacgttcgctgataatgtactccacccccatcaggcgcgcgtttttcgtattgccgtcgtaaatcaccgcctgcatgacatcttcgttcaggacggtaacgtaatggtgcgcttccatctgtccgtttttatcaccgctataaaaatggaacccgtcaaggtaggtactgatggcatcgacaggtggtctggattgaatagccgccgcgcctgtttccagggtacgtaatttggcagatgttttttccccgggaataggcgtttgcggcggcgtattattggcgccgcatccggccagaaaaggaatgataaagagtgccagcggtaaaattttcattaggtctccatatagtgaaagggctctaatgaaaatagtgcaataccacgtgattggtagaagaaatggaagatgctatttgtgacggtgtcacaaatagtaaaacccgacacacaggccgggttttgatatcagtttactcttattttgagagttctttcttgatttcgtcttttattttgcttaattcactctgcgggtttttcttacaaagctcaacggctagcggcactgctgtcgtctcagtttcctggaaatcaacgtagtccccgcctttaaaatcttcatcttcattcagcacccagaaagcgactggcgccatcgtctgcggattgaggtcaacaaactcctggcagctcatacctttaggcgtaacgtttgttttagtagtatctgttgccgcattcacgctaacactggttaccagcgctgccacgataatacctgctgtagcaagggagaatttattcattgttgttgctccaataattatataaataacctctacatctgcgcgttaacccgttaatgtagaacgcagaaaataataccccacctctctcaggaataaagatcaccctccgtgatatggctattattgatatttacgttgactgattttgatgtttgatgaataaagcaacatggcgagcagattttagggcgaaaaagtagaccacgacaacagcaaatgacgagtatgcgctacgttgagctgatgaaagagaacttcgctctgacatgccgtcgcaatcgcgcgccagccagacacaaacggtgggcagaacaaacatcgtaaacagattgcctgtcagcatcccggaggcaaccaccagccctgtccaaaacggcttgcggtgtctacaccgctggcgaaccttatcagggctaaaccaaccactattgccccggtagtcatcagcaccgggcgcaatcgaatctacaatacaatttcatagcatttacagatagtcggacaatttcaggtttccgtaatcataaaaataccttttgcacacaaactgtatacttccagtagatttattgttatttagcactataactgcaagcagttgaatccaaagggtaataattcaggtattatttggagggaaatttatataattaagataaataaatgcttatcggttaagtgagcgacgtttaagttttgttgcaaccacggctttatactttttacgagtgctattttttttggctaattaaaaaggtaaagttaatgaaactatccgtaacattggcgtttttcggttacatgatggtatccagtatggcacaagctagcgatatcaatatgtggcgtgaacccaaacctgttgtgaaagagggtaaatattacagcttaatcatggatcgtggcgagttgcaaaaagcagtaaaaagcagcagcaataactatctcttttccgaaaaaggtgcaggagtgaagccgctggtattgatcggctctccggtagagattagcgaatttatgttgcaaaataaaactcgcagcattgaaaaccacattaaaggtctacctgacatttatatgggagtgacaaaatataaacccaaacaacgttttaccggcttatttccgctacaggatatattgactcaaactgttgatcaggtatcgaaatttgtgcccggtaccgatatcaccgatgcggtgggaatcccctccgacctaaaagcattacagcaagccattttggctatgaagcaaaaagataaaatcagcaaaaatatactgtacgtcaaatttagctacttgccggaagatggaatggtgaaagtaggaagcaaaacagtttcttttggtcgtattctggagaaaatgcagcagagtaatcgtaccctgcgtagataagcaggaagcaggcagtatttccagcttctggaatgttaaagctacaaaagttgtctggaggtaataggtaagaatactttataaaacaggtacttaattgcaatttatatatttaaagaggcaaatgattatgaccggaatatttgcagaacaaactgtagaggtagttaaaagcgcgatcgaaaccgcagatggggcattagatctttataacaaatacctcgaccaggtcatcccctggaagacctttgatgaaaccataaaagagttaagccgttttaaacaggagtactcgcaggaagcttctgttttagttggtgatattaaagttttgcttatggacagccaggacaagtattttgaagcgacacaaactgtttatgaatggtgtggtgtcgtgacgcaattactctcagcgtatattttactatttgatgaatataatgagaaaaaagcatcagcccagaaagacattctcattaggatattagatgatggtgtcaagaaactgaatgaagcgcaaaaatctctcctgacaagttcacaaagtttcaacaacgcttccggaaaactgctggcattagatagccagttaactaatgatttttcggaaaaaagtagttatttccagtcacaggtggatagaattcgtaaggaagcttatgccggtgctgcagccggcatagtcgccggtccgtttggattaattatttcctattctattgctgcgggcgtgattgaagggaaattgattccagaattgaataacaggctaaaaacagtgcaaaatttctttactagcttatcagctacagtgaaacaagcgaataaagatatcgatgcggcaaaattgaaattagccactgaaatagcagcaattggggagataaaaacggaaaccgaaacaaccagattctacgttgattatgatgatttaatgctttctttattaaaaggagctgcaaagaaaatgattaacacctgtaatgaataccaacaaagacacggtaagaagacgcttttcgaggttcctgacgtctgatacattttcattcgatctgtgtacttttaacgcccgatagcgtaaagaaaatgagagacggagaaaaagcgatattcaacagcccgataaacaagagtcgttaccgggctgacgaggttatcaggcgttaagctggtagtcgagggtgatttccgcattcagaacctgcgataccggacacccggcttttgctttctggatgatttgatcgaaagttgaagcatcaatatctgctaccgccactttgctttgtagcgcaattttggtaatggcgaagcccgcctccaccttatcaagcgatacgtcagcggtggtgtcaatggatgtcggcgtaaatccagcctctcccagcatgagtgatagcgccatggagaaacaggccgcatgtgcggcgccaattaactcttccgggttggttccctgcgcgccttcgaaccgggtattgaatccatacggttgttgattaagcacgccgctttctgttgatacagtacctttaccccgtttgatgtcgccttcccagtgtgcctgacctttcttatggattgtcatttttgctctcctgttggctcaaaaaataaagtatagactatgctgataatctgcgttgttcatgccgatggatgtagcatgttgtcgattacccgcacttcagatatagaaaatagttgtatgctttttcagtgatggatattaaaccaacaggcctccctttctttaaagaatatatccctccttttatccttactttttcttccggaagcgtattccattatgtatattttcattcatattaagatttatcttatctcgttgtaataaatgataaaaatcgcaataagtagcattttaaatgtatattaattgaccactatttgtatgaggatatgtaattggcaaacataatatattttcttctggggtaaacaattagagttccgccttgcgttaaaataactccaggactaatcttaaccacagccgcaaaaatatttgccatgctgaatacgaattaattttctgcgagccgtactaaataaatacatgttcacggaggcattatatgtttacttatcactcagcaaatacctcagcagcacaaccggccctggtcaacgcgattgaacaaggattacgcgcggagttaggcgttgtcactgaagatgatattttaatggagctgaccaaatgggttgaggcttccgacaatgacatcctcagtgacatctaccagcagaccatcaactatgtggtaagcgggcagcacccgactctgtaaaacctgctatgctgtatcggcaaccttaggggttacgtttctttcgcgtaagcgaatttgtccttaaaactagcaacaggattgaggagttaacatgaaatcgaaccgtcaggctcgtcatatacttggactggattacagaatttccaaccagcgtaaggttgttactgaaggcgacaccagcagcgtggtgaataacccaaccggcagaaagcgtcgcgccgatagccaaaagtaatcgtacagtcctgaaatgacgttaaacaccattgcatctgcaatggtgtttttgtttataggaatgaccttaacgtctcacaatgctttatactcagggtcggttccctggtggaaggcaatatatgatgataaacgacggtgccagggacagttattcgaaaaagagtgagcaacatggaaactacaaccaagaaagcacgttccctttatatcccttacgctggccctgtattgctggaattccccctgttaaacaaaggcagcgcttttagcgtagaagagcgccgcaacttcaatttgtcaggactgctgccggaggtcgtcgagtcgattgaagaacaggccgaacgcgcctggctccagtatcaggggtttaaaacagaaatcgataagcatatttacctgcgtaacatccaggataccaacgaaacgctcttttatcgactggtgcaaaaccatcttgaagagatgatgccggttatctataccccgaccgtgggcgcggcctgtgagcgcttctctgagatttatcgccgggcgcgcggcgtatttatctcttatccgaaccgtcacaatatggacgacattttgcagaatgtgcctaaccacaacattaaagttattgtggtgacggatggcgagcggattctggggcttggcgatcagggcatcggcggaatggggatacctatcggtaagctgtcattatacaccgcctgcggcggcattagtccggcctatacccttcccgttgtgctggatgtcggcaccaacaatcaacagttactcaacgatccgctctacatgggctggcgtcatccgcgcattaccgacaatgagtattatgcgtttgtcgatgagtttattcaggccgttaagcagcgctggccagatatcctgctacagttcgaagatttcgcgcagaaaaacgcaatgccgctgttgacgcgctatcgtgatgagatttgctcctttaacgatgatattcagggcaccgcagccgtgaccgtcggtacgttgatcgccgccagccgcgctgccggcagtcagcttagcgagcagaaaatcgttttcctcggcgcgggttcagccggatgtgggattgctgaacagatcatcgcgcagactcagcgtgaaggtttaagcgaagatgccgctcgacagaacgtttttatggtcgatcgcttcggcctgttgacggaccggatgcctaatttattgccgttccaggcaaaactggtgcagaaatgcgacaatctccagcactgggataccgaaaatgacgtgctgtcgctgctggatgtggtgcgtaacgtgaagccggatatcctgatcggggtttccggccagaccgggctctttactgaagagatcatccgcgagatgcataagcattgccctcgcccgatcgtcatgccgctctctaatcccacctctcgcgtggaggccacgccacaggacattatcgcctggacggaaggcaacgcgctggtggcaaccggcagcccattctcgccggtcatctggaaagataaggtttatccgatcgcacaatgtaataacgcctatattttccccggcatcggacttggggttatcgcttccggcgcatcgcgcattactgatgaaatgctgatgtcagccagtgagacgctggcgaaacattctccgctggtgaataacggcgaaggattagtgttaccagcgcttaaagacatccaggtcgtgtcgcgcgctatcgcttttgccgtaggcaaaatggcgcagcaacaaggcgtagcggtgaaaacctctgcggaagcgctgcaacaggcgattgacgataacttctggaaaccggaataccgcgactaccgtcggacttccatttaatacgtacccggcggtgaatgccgccggatatcactttcttctttagttttggtgagtctgtcgacacacctgaattcctttccctgcttatttgtcaagctactaatattagccacctttatgtattgaacgaggatttatcaggataatcctggctaaactattacattgtatttctgccgccttgcataactcatcagaaatattaatcctaaagaggtaatagcaccttacctgctattacctgctatgcagttcactattaagaaaaggagaaggttatgaaagctgctgttgtcacacaagatcatcaggttgatgttactgagaaaacgctgcgtccccttcgccacggtgaagctttgctaaaaatggagtgctgcggtgtatgccataccgatctacacgtgaaaaacggagatttcggtgacaaaaccggcgttattctgggacacgaaggcattggcgtcgtggcggaagtcggtcctggtgtcacctcgctgaaacccggcgatcgcgcgagtgtcgcgtggttttatgaaggatgcggacactgtgagtattgcaatacgggcaatgaaaccttatgccgcaacgtgaaaaatgccggttacacggtagatggcggcatggccgaagagtgtattgtcgtcgcggattatgcggtgaaagtaccggaaggcctggactctgcggcggcaagtagtattacctgcgcgggcgttaccacctataaagcggtgaagatttctcatattaaacctggccagtggattgccatctacggtctgggcggtctgggtaatctggccttgcagtacgcgaaaaacgttttcaatgcgaaagtgatcgccattgatgtcaatgatgggcaactgaaactggccgaggaaatgggcgcagatctgaccattaattcacgtacggaagatgcggctaaaattgtgcaggaaaaaaccggtggcgcgcacgcagcggtggttaccgcggtcgctaaggcggcgtttaattccgcagtagatgccgttcgcgccggaggccgcgtggtggcagtcgggctgccgccagaagccatgaaccttgatatccctcgcctggtgctggatggcattcaggttgtcggttcgttggtggggacacgccaggatctgaccgaagccttccagttcgcggcggaaggaaaagtcgtgccaaaagtcgctttacgtccgcttgaagatatcaacgttatttttaaagagatggaacagggacaaattcgtggccgtatggtcatcgatttccgtcgttaaacgatttgctgtggttctgccagaacgttgacgtttcagtcaccagcggatcgataacgaccagatacttcagtttgcttaagctttgcaccactttgtttttgtccgggaaggacgccaccgggttaaagccctgacagaaatagccggtaactttcccgctatccatcatgttgaaatatttgatcacatcataggactgatcccacttaggcagccaggcaaagccccagtcattctctttctgcgccgcatcgccatagaaagatttcatcaggctgacgaagaacttaggataattcccccagtagttgacctgatcggccagcgtcgctttgggggtattcgcggccagataagtttgcagatcggcctgtttttctgacggtagcgtcaggtagcccggcaggctggtggagagcagtcctaaatccgttaagccctgaatattagagtggccgcgcaaggcgttcacaccgccgccagccatccccatattgccgagcagcaactggatcatcgccatagtacggatgttctgcgccccgacggtatgttgcgtccagcccagcgcatacaggaaggtcgtagtgcgatccggcgcgctggtagaggccaacacctcacacaccttcaggaagtccgctttcggcgtaccgcagatgttttccacgacgtccggcgtatagcgcgaaacgtgctgcttcagcagattccacacacagcgtgggtgcgtcaacgtttcatcacgtttggcatagccgttttcatcgaactggtagttccaggaggatttatcgtactgacgcttttgggcgtcatagccgctgaaaagaccgtcttcgaacgtaaagtcttcccgcaccagcaggctggcgttggtgtaatgcttaacgtattcagcgttgattttgttattttcgatcaggtacagcaaaacgccggacagaaaggtaatgtctgtaccggaacgtattggcgcatagatatccgccaccgacgccgtacgcgtaaagcgtggatcaacgacaatcagcgtcgcatcgttattatttttcgcttccatcgcccagcggaaacccaccggatgcgcttctgcggcattgccgcccatcaccatcagtcctttcagggctggctttttctcttgatgtagactcggtcataaggagtatgccgtgcagacgttcactggtcgttgtctttgcggacaaagccattttaccgttgacgtcgaaatgctggatgtctatgcctgccattgtacgctgtgtcaaaaatggtcgggtggaatagccatgtatctggaagcctgcgggcaaccacagctagcccccctttccccggaaccgccatacttttcatcctcttcgcgcggcgaacgctacttctgttctggctgcgggtgtccgctgtggtttcggcttaccgataccgatcgctatttttccctggaccttactggaactgaacgaagttgatcgccgtcggctgattctggctgcggaaatttataccgaaacccagcctgccttctggcgactgacggggcaatacgcacgcctcagcggtaaagaggttgaggaaatagactccccctgccagctagcgcattaagcgcttatctcatcaggcgttatgttatcggcgttgggcttttgccaggctgaaccacatccctaccgccagcaaaagaagcatactcccggcgctgcttaacgccacgctatgcgaccagataaaggcgtgtctggcggcgtccagtattgcctgcccctgcgtgggcggcaggctattcgccaactgcacggcttctcccattgaagatgacgctctggcaatctcttgcgcctcaagcccggcaggcagacggatagacgcggagaagctacggcttaacaacaggccgaaaatggcgatgcccagtcccgcgcccagttcataagccatcgtttctatcgcgccggccgccgccgctttttctgccggcacagcggccataattgccgacgtggaagccagcaatgcgctggcggtgctaaatcccagcagcgccatcagcccccaggcctgccattgttgggtgctgaaatccgtcatcgccagaccataaaaactcagcgcgcttaacgccatgccgcccgtcgcgaccagccgtaaccccagacgcgagaccagcgcgcccgcaatcggcccgctgaatccactggcgaccatcaccggcagcataaataccccggcctcataaggcgatagcccgtgaacaaactgtagctcttgcgccatcagcagctcaaaacccaccagagtgatcatcgcggtcatcgccatcacgacgccgctcaggataatgcgatgggtaaatagtcgcatatcaatcatcggacgcgatgtcgcaagctgtgtgcggataaagagtcccagtagcaacgcgccggtaagcagggtaagcgagatgacccacagcgacaaattccctttcagcgcggttttagcgctatagaccaacagcaaaatggcaataatcagcatcaccgcatggccaagattgagcggttgatcgcgacggcccgcctgacgaggaacatagcgggcggttaagcccatgacgaccagcacaatcggcacgttgatcaggaaaaccgatccccagtaaaaatgctctaataatatgccgccgatgagcggcccaaacgccgctccgcccgaacctaccgcagcccagacgcccagcgccatgttgcgatgcttctcttcacaaaaggtggcgcgtatcccggccagcgtcgccgatacaatcatcgccgcgccaatagccagtaataccctggtggcgataagccaactggcggtatgcgaaaacgccgccgccagtgatgccaggccaaagagcgtcccgcccagcatcagcaggcgtttaaaaccgatacgatcgccaagcgcgcccatcggcaacaccatgccagccatgaccaaagaataaatatcaatgatccacagcagctcgttgccgctggcccccagtgtcatactcagtgtcggcgcggcgacatgcaagaccgtggcatcaatggcgacaggaatatagaccagcacaataatgactaacgttaaccactgacgaaacataactctcccttcaaaaacttaaacctggacacctgtccaatttcaggatcctacggtaagttgaacgaatgtccagctttttgttacactgcgcgcattggctaatgtggggaaaatatgagttaccttaaccgggatgaacgccgcgaagtgatcctgcaagcggcgatgcgcgtggcgctggcagaggggtttgccgccatgacggtgcgacggatcgcatcagaagccgatgtcgccgccggccaggtgcatcaccacttcagctcggcgggcgagctcaaagcgctggcctttgtccatttgatccgtaccctgctcgatgccgggcaagttccgccgcccgccacctggcgtgcacggcttcacgctatgttgggtagcgaagacggcggctttgagccttacataaaattgtggcgagaggcgcaaattctggccgaccgggacccgcacatcagagatgcttatctcctcacgatgcagatgtggcatgaggaaacggtcacaattatcgagcagggcaaacaggcaggagaatttacgtttactgctaacgccacggatatcgcctggcggcttatcgcactggtgtgcgggctggacggtatgtatgtgctgggtattccggaaatggccgatcccgcgtttaaataccatctggatcgtatgattacgcttgaactctttgcgtaaagttacaaataatttaataaaaatcgcttttaatttacaaatagtaacaattaagaaacatcatatctcctcttcgcgccgcgctggcctggttttttatctattctttcactcaatattctaaaaaaacttcaataagttctcaaaagagcgcgtgacgctctgtctcttttttgtgttttttttcaaatgatatgcgcatgtgaggggtaaaatgacacgacaaaacgagaattataaccgttatctcttgagtgactggcgacccgaaaatccagccttctgggagaataaagggaaaggcatcgccagaagaaacttatggatttcagtaagttgtttgctccttgcattttgcgtctggatgttgtttagcgctgttgccgtcaacctcaataaaattggatttgattttacgaccgaccaactctttttattaaccgcattaccttctctttccggcgcaatattacgcgttccctactcctttatggtaccactgtttggtggtcgtaaatggaccgtattaagtaccgtaatattgattattccttgcgcctggctgggattcgccgtgcaaaatcctgccacccctttcggggtatttatactcatcgctctgttgtgcggttttgcgggggcaaatttcgcgtccagtatgggcaacatcagttttttctttccaaaagccagacaaggtagcgcgttgggtattaacgacggactgggaaatcttggcgtcagtgtgatgcagttgattgcgccgctggttatttttttgccgatatttacttttttaggcgtccggggcgtgccgcaacctgatggctccctgctcgccctcactaacgccgcctggatctgggtgccgttactggctgttgcgacgcttgccgcctggtttggtatgaacgatatcggcagttcaaaagcgtctgtcgcctcgcaattgccggtgctaaaacgtctgcacctgtggctgcttagcctgctgtacctggcgacattcgggtcattcatcggcttttccgcaggtttcgccatgctcgccaaaacgcaatttcccgacgtaaacattctgcaactggcgttctttggcccctttatcggcgcgctggcgcgatcggcaggcggcgtgatctccgataaattcggcggcgttcgcgtcacgctcattaattttatctttatggcgctgtttaccgccctgctattcctcacgctgccaggctccggcgcaggcagctttagcgcgttctatcttgtttttatgggcctgtttttgacagcgggtctcggcagcggttctaccttccagatgattgcggtgatcttccggcagatcacgctctacaacgtcaaactgcgcggcgggagcgatgagcaggcgcagcgcgaagcggtgacggataccgccgccgcgctcggttttatctccgctattggcgctgtgggcggcttctttattccaaaagcgtttggcacctctttggccttgaccggctcgccggtgggcgccatgaaaatctttttgctgttttacatcgcttgcgtcctgctgacctggctggtctacgggcgtcttaagcctaaacaacaataacaacatacgcacttgtaggacggccatccggtaatggtttaacgccaaatcgacaggatggcggaaaatttatcgaagcaggagaaatgtcatgagtaaactgttggatcgctttcgttactttaaacaaaaaggcgatacctttgctgacggccatggtcagatgatgcataccaaccgcgactgggaagacagttatcgccagcgctggcagtttgataagatcgtgcgctcaacccacggcgtcaactgcacgggctcctgtagttggaaaatttatgtcaaaaatggtctggtgacgtgggaaacccagcaaaccgactacccgcgcacacgtcccgatttaccgaaccatgaaccgcgcggcgccagctactcctggtatctctatagcgccaatcgtttgaaataccctctggtgcgtaagcggctgatagaactgtggcgagaggccctttcccgccacagcgatccggtgctggcatgggaatctataatgaacgacccgcaaaaatgccaaagttacaaacaggtgcgcggacatggcggctttattcgttcgaactggaaagagctgaatcagctcattgccgccgctaacgtctggacaatcaaaacctatggcccggatcgtgtggcgggtttttcacctattccggcgatgtcgatggtttcttacgccgccggaacacgttatctgtcattgcttggcggtacttgtctgagcttctatgactggtattgcgatcttccgcccgcgtcgccaatgacctggggcgagcagactgacgtgccggagtccgccgactggtataactcagcctacattattgcctggggctctaacgtgccgcaaacgcgtaccccggacgcccacttctttaccgaagtgcgctacaaaggcaccaagacaattgccatcaccccggactattccgaagtcgctaaactgtgcgatcagtggctggcgccaaagcaaggtaccgacagcgcgctggcgatggccatgggtcacgtcattttgaaagagtttcatctcgataatcccagcgactatttccttaactattgccgccgttataccgacatgccgatgttagtcctgttggatgagcgcgcagacggcagttatgtaccggggcgtatgatgcgcgcgtcggatctggtggatggactgggagaagccaataatccggaatggaaaaccgtcgcgctcaacagtacgggcgaactggtcgcgcccaacggttctatcggttttcgctggggcgaaaagggaaaatggaacctggaaccggtggcggcgggcgtcgaaactgaactgtcgctctctttactcggtcagcatgatgacgtggcgggtgtcgccttcccctattttggcgacaacgaaaacccacattttcgcagcgtgcggcaggaaccggtgctggtacgtcagttaccggtgaaacgcctggctctggcggacggtagcgagcggatggtcgtcagcgtttacgatctggtgctggctaattatgggctggatcgtggtctggatgacggccatagcgccaataattataacgatgtcaaagcctacacgccggcctggggcgaacagattaccggcgtgccgcgtcgacatatcgaaactattgcgcgtgaatttgccgagaccgcccataaaactcacggtcgttcgatgatcatcctcggcgcgggagtgaatcactggtatcacatggatatgaattaccgtgggatgattaacatgctggtgttctgcggctgtgttggacaaaccggtggcggctgggcgcactatgtcggccaggagaagctgcggccgcaaaccggctggctgccgctggccttcgcgctggactggaatcgcccgccgcgtcagatgaacagtacctcgtttttctacaaccatgccagccagtggcgctatgaaaaactgactgcgcaagagttgctgtcgccgttggccgatccgactaaatttaccggacatctgatcgatttcaacgtgcgcgcggaacgtatgggctggctaccctcggcgccgcagcttaatcttaacccgctcagcgtgaaagcgagcgccgataaagccgggctgtctgcggcggattataccatgcaggtgttgaaatcaggcgctatccgttttgcctgcgaacggcctgacagtggtcataatcacccgcgaaatttatttgtctggcgctctaacctgctcggctcctccgggaaaggtcatgagtacatgctcaaatatctgctgggcaccgacagcggtatccagggcgaagcgctgggttccagcgaaggaattaagcctgaagaggtggaatggcagtccgccgcgattgagggcaagctcgatctgttggtcacgcttgatttccgtatgtccagtacctgtctgttttccgatatcgtcttgccgaccgccacctggtatgaaaaagacgatatgaatacctcggatatgcatccgtttatccaccccctttccgccgcggtcgatcctgcctgggaatccaaaagcgactgggagatctacaaaggcatcgccagcgccttttctgaagtgtgtgtcggacacctcggacaggaaaccgatgtggtgttacacccgctccagcatgattccccggcggaactggcgcagccatttgatattctcgactggcgtaaaggcgagtgcgaacttattccgggcaaaaccgcccccaatatcgtcgtggttgaacgcgattatccggccacctatgaacgttttacctcgctgggtcccctgctggataaattaggcaacggcggtaagggtattgcctggaatacgcaagatgaagtcgatttcctcggtaagctcaattacaccaaacacgatggcccggcgaaaggacgtccgcgcatcgacaccgcgctggatgcctcggaagtgattcttgccttagcgccggaaactaacggccaggtggcggtgaaagcctggcaggcgttgggcgagatgaccgggcgcgagcacacccatctggccatcaataaagaagatgagaaaattcgctttcgtgatatccaggcgcaaccgcgcaaaattatctccagcccgacctggtcaggactggaaagcgagcatgtctcttataacgccgggtataccaacgtacatgaactgatcccgtggcgcacgttgtcggggcggcaacaactctatcaggatcatgcgtggatgcgcgcttttggcgaaagcctggtggcatatcgcccgccgattgatacccgcagcgtcagcgaaatgcgagaaattccgcccaacggtttcccggaaaaagcgcttaacttcctgacgccgcaccagaaatggggaattcactccacctacagcgaaaacctgctgatgctgaccttgtcgcgcggcgggccgattgtctggatcagcgaagccgatgcccgtgaactgggtattgaagataacgactggattgaagccttcaacgctaatggcgcccttaccgctcgcgcggtggtcagccagcgcgtcccgccgggtatgaccatgatgtaccacgcccaggagcggattatgaacattccgggttcggaagtcaccgggatgcgcggcgggatccataactccgtgacccgggtctgtccaaaaccgacgcatatgatcggcggctatgcgcaactggcttacggcttcaactattacggaaccgtgggttcgaatcgcgatgaattcatcatgatcaggaagatgaaaaacattaactggctggatgatgagggccgggatcaggtacaggaggcgaaaaaatgaaaatacgctcacaggttgggatggtactgaatctcgataaatgtattggctgtcacacctgctccgtcacctgtaaaaacgtctggaccggacgtgaagggatggaatacgcatggttcaataacgtcgaaactaaaccgggtattggctatcccaaaaattgggaagaccagcaggagtggcaaggcggttgggttcgtgatgttaatggcaagataaggccccgtctgggcggcaaaatgggggtaattagcaaaattttcgccaacccggtgattccgcaaatcgatgattactatgaaccctttaccttcgattatcagcatttacatacagcgccggagagtaagcatcagcccactgcccgtccgcgttcactgatcgacggaaaacggatggacaaggtgatctgggggccaaactgggaagagctgctcggcggcgagtttgaaaaacgcgcccgcgaccgcaacttcgacaacatacaaaaggagatgtacggtcagttcgaaaacaccttcatgatgtacctgccgcgcctgtgcgaacactgcctgaaccccagttgtgttgccacctgcccaagtggcgctatttataagcgtgaagaagacggcatcgtgctaatcgaccaggataaatgccggggctggcgtttgtgtatcagcggctgcccatacaaaaaaatctactttaactggaagagcggcaagtctgagaaatgcatattttgctatccgcgtattgaatccggccagccgaccgtttgctcggaaacctgcgtcgggcgcatccgttatcttggcgttctgctctacgacgccgacaggattgaagaagcggccagtaccgaacacgagacagatttgtatgaacgtcagtgcgatgtgtttctcaatccgcacgatccggcggtcatcgaagaggcgcttaaacagggcatcccgcaaaacgtcatcgacgccgcccaacggtcgccggtgtacaaaatggcgatggactggaagctggcgcttccgctgcacccggaataccgtaccctgccgatggtctggtacgtaccgccgctatcgcccatccagtcatacgccgacgcgggcgggttgccgcacaatggcaatattctgccggcggtggagacgctgcgtattccggtccagtacctggccaatatgctcagcgcgggcgataccggcccggtcattcgggcgctaaagcggatgatggcgatgcgccactacatgcgctcgcagacggttgaaggcgtgacggatacccgcgccattgacgaagtcggtctgagcgtacaacaggttgaagagatgtatcgctacctggcgattgccaattatgaagatcgttttgtcattcccaccagccaccgggaaatggcgcgcgatgcctttccggagcgcaacggctgcggctttacttttggcgacggttgtcacggctcggataccaaattcaacctgttcaacagtagccgtattgatgccatcaatatcaccgaagtacgtgataaagcggagggggaataatgcaaatcctcaaagcgattggcctgttgatggagtatccggacgacgagttgtgggaatgtcgggatgaagcgcttgccctaatccaacacgatgcgccaatgctggccaacttcactcgcgagctgctttatgcgccgttactggataaacaagcagaatggtgcgaagtgtttgaccgcgggcgcgccacttcattgctgttattcgagcatgttcatgcggagtcccgcgatcgcggccaggcgatggtcgatttgttaagccagtatgaaaccgtgggcctgcacctcaactgccgcgaactgccggatcacctgccgctctatctggagtacttaagcgtgttgccggaagcggaagcgcgcgagggattacagaatattgcccctattctggcgctactgggcggtcgtctgaaacagcgaggagcgccgtggtatcaactatttgacgccctgctgacgctggcgggcagtacgcttacaagtgacagtgtcaccaagcagattgttcaggaatcgcgggatttttcctgctcttcccgttcacccgtctggttcatgtctggagcgcgccgttcgagtatttcacccgtcgctaccagattgttcgtacccgccgctaattctctttgaccgggggtacgcttaccgggcaaagaaaaacgcctgggcgtcgtcattcggcaacgcacaggctatgatgattcttcagtcaaaggagaacatcaatgaaaccgcagatttaccatgttgacgccttcaccagcgaaccctttcgcggcaactctgctggcgttgtcttacatgcggatacgctaagcgacgcgcagatgcagctgattgcccgtgaacttcgtcactcggaaaccgcctttttgctaaaaagcgaagagagtgatgtgcgcatacgctactttacaccgacagtagaagtccccatctgtggtcatgccactgtggccgcgcattatgttcgggcaacggtactggggttgggaaacaccaccgtctggcaaacctcgttagcgggccgtcatcgcgttgaaattcatgccgaacacaacgactatcgcatcacgctggaacaaggtcagccctcttttgaaccaccgctagtcggagagattcgggctgccatcatcaccgcactgaacctgactgaagatgatatcgtgccgggagcgccaattcaggtggcttcaacaggacatgcaaaagtgatgatcctgctcaaaccagacgttgatattgatgccctttcgccgaatctggcagccctgacggcaatcagccagcaaattggctgtaacggcttttttcctttccagattcgtccgggaaaaaacgaaaccgatgggcgaatgttttccccggcgataggaattgtggaagatccggtaacgggaaacgccaatggcccgatgggggcatggctcgtccatcatggcctgatggcgcatgacggtaaaacgctacagattcaaggccatcaggggcgcgctttaggcaaagagggtactgttgatgttaccgtcaccattcgcgataaccagccggaaaacgtcaccatctccggccaggcggtcattctgtttcatgccgaatgggccattactttttaatctttgtcaggcccgcaaatcctcgcggcaaaaaattattttcccgcctccggatgggtatcaaatgcagccattaccgcggccagctccgcctcggtaaaaccgtgctttacatcatttacgccgagaccaaactgctgctgaagtaactgatacaacgacggtacatccggtatattgacctgttcaacggcatgtccctggtggtaacgcgtgaagtggaaattcgttaatgtcagcttgccgccatcaggcaaatggcggcacatcaacaaatgatgacgaaaatgggattgcggccagtgagccgaccagaaattgcccattacatgatcgctctgctgctgcacccccagatcaaaacagtacatcgactgccagtgctcatggtggcggaattgtaaaatccatgtgctcccctcctgtatcaggcggtattcgccatgcggcgtttgctgggcaatttcagcctgcagacgaagcggtgcggttagcgtttggccgccaaaccccacgtccgcgatccactgctcatcctcaacatcaaccagcagcaaacggtgcgtgcgcggcggtaaactggcgggatgagacagaatgacccgccccaataagcttcggacgttaaaaccgatgtcgcgtaacgcgcgttcaaacaggccattcagttcaaaacagtatccaccgcgtcgggcataaagcagtttctcctctagtgccgtctcatcaagctgtatttcacgaggcagtagcacatccagattttcaaaaggaatcgcgcagttgtgcgctaagtgaagcgttctgagcgcttcaaccgtaggaccccccaacggctgacaatttaatcgcgtaaaataagcatgtaaaaaagaggtcatctgaggcttccattaacattaatgcttgcgttcggcacacaggctgaggtggatatcgctgcgcaacaggataccctatccgtggaatagcgttggatacttttgaaaaaataagacaggccggctacagccgccggggtacgtagaattttggcgtataaacggaaatcgggttctgagaatctctttgcgacacgccgccaaaatagcggcgtgttaaaatttttaacgccagctcagcgagtctgatttctaacaaaactggctaaacataaacgctttttaatacttgtctaaatagttatggtaacgatcttttatgtcggccgcccgttgcgctttcgcctccggcatgtcgttggcccgatcggtataatattttaaactcggaatggcgcctaatgcctgaggtaaggcattatatgctgctattcgctctctgacggttttatatttttcatcaatatcataaccatagtatgctggcgcttcaaaaaagccctcttccagtctcatacagatatcttcaaaggaccccttaacctcaacgctatgttcgccatccgatatcctgacgattggctcacgtccagccatcagcgagagttgttcgaatgttaacatccgaccatcagaaagctcgacatctataataaattgttcatcacgtacagcatctgcaaggtgattatggatattccctgcattggcacagaactcatcaactttaggcgtaacattgcaataatgttcaattactcgcgtaaatccgtaggccagtcctgcggtaagcacatacaagatgcctttcatgatttttgttgataatttattttcataatctcctgcagcaacatgaggtagcttatttcctgataaagctctggcataggtagaaactgatgtatatggcatatcctgctccttcaaattttgctcaatagctttatatgtcctactcctctctcattatgacgatatgtcaatcaacaaaattgctcaaaggcatacattttcaggagaaaatgagaataacaggcgcaacggcctgatcttatgctgcttcaatatcgtcaggtggtttatcgttcgaggtcatatctatgaccataaatccctgcagggattaactctgattaattattgcgcaacgcaatcactgcggatttgtgctgaaagcttatctggctgaatcgtgaccacaccgcaccacatctgaccgcacaaataaacacgacatcctcattttgttctttccgtatgttttgcgtcatttaacaattgcaggtaggatgctccgccggcggttttatccctgtcacagaatcagggaaaagcggcattcgccattgcaggcaatcgattggtgagcgcccgtcgcggcataaggaatttttctgtcaggacaggctataacaggtaacgtaatgaaaacacagactacgcacgccgcagaacaacatgcggcgaaacgacgctggctgaacgcccatgaagaggggtatcacaaagcgatggggaatcgtcaggttcagatgattgctatcggcggcgcgattggcaccggtttatttttaggtgcaggcgcccgattgcaaatggccggaccggcactggcgctggtctatctgatatgcggcattttttcttttttcattttacgcgcgctgggcgaactggtattgcatcgcccttccagcgggagcttcgtctcctacgcccgtgaatttttgggtgaaaaagcggcctacgtagcaggctggatgtactttattaactgggcgatgaccgggatcgtcgatatcaccgcagtggcgttatacatgcactactggggcgcatttggcgacgttccgcaatgggtgtttgcgctcggcgcgttaaccattgtcggtaccatgaacatgatcggcgtaaaatggtttgccgaaatggagttctggttcgcgctgataaaagtactcgccattgttatcttcctggtggtaggcacgatttttctcggtaccggtcaaccgcttgagggtaatgccaccggttttcacctgattacagataatggcggctttttcccgcacggcctgttgcccgcgctggtactgattcagggcgtggtgttcgcttttgcttcgattgaattggtcggtaccgccgctggggagtgcaaagatccacagacgatggtgccaaaagccatcaatagcgtgatctggcgtattggtcttttctatgtaggatcggtcgtattgctggttttgctgctgccgtggaacgcctaccaggcggggcaaagtccgtttgtcaccttcttttctaaacttggcgtgccttatatcggcagtattatgaatatcgtggtgttaaccgccgcgctttccagcctgaactccgggctttactgtacggggagaattttacgttcaatgtcgatgggggggtccgcgccgaaattcatggcgaaaatgagccgtcagcatgtgccctatgcgggtattctggcgactctggtggtttacgtggtcggcgtgttccttaattatctggtcccctcccgcgtgtttgagatcgttcttaattttgcctcgctcggcattatcgcgtcgtgggcgtttatcatggtgtgccagatgcgtttacgccaggcgataaaagaaggcaaagccgcagacgtcagttttaaactgcccggcgcgcctttcacctcctggttaacgctgctgtttttattaagcgtgctggtactcatggcgtttgactacccgaatggaacttacactatcgcctcgttgccgctgatcgctattctgctggtcgccggctggtttggcgtgcgacgtcgcgtggcggagatccatcgcactgcgccagtgacggcggattcgacagagagtgtcgtattgaaagaagaagcagcgacataacattacccttccccggcagcctcaggcctgccgggtttaatgcgcgttgccgccaacaccgcatcgcgcccaatgcttagtcagccttaatcaactgcgccacatcattgctgttaatttcccgctggttgccttcctgatcggtataactggtcattcccgtctctttatctaactgcggcttaccctgagttacgatcgtttgcccattcttcgtcgtcatcacatagttggttgtacaacccgcaagcataaaaaacatcatgcccaaacctgagcatataaataactttttcatattttcctcgtgaatataatgagttaacgactgcaaaaaggtagtgtaattctcacagaatcatcaggctatcggcggggtttaacgaggcgtatcggtgcgtttaaagagatgactggaggggtttccccctccataccctatttacagagcaatgcgaataacatcatccggctgcgtcgcttcttgttcacgtgtcgatttctgcttcacgctgacgtagagcgttttaccgtctgccgatagcgccaggctattcgggtacgtcggcgtatcgaacgttttaacaacgttataggtcttcgcatcgatcacgctgacctgccctgcctgacggtgcgtcacatacgcctcgttacgtgtcggattatacaggacggccaaagaggcaggcgccgcgattttggcaagaatattgccattacgggtatcgacaaccagaacctcagttgccttcgagtcggtgataaacgcgcgatgacctgcggtatcgagactcagattaataaagaagtgttctttaccgtcatccagcaacttcttacgactgagaattttattgctggcggtatcgatggtgataaattcgccatccgcattggtggtgtacaggcgttgtgctttactgtcgagcgccagacccgtactcattttgccggtattttcgatcgtcgttttcagtttgatggtttcgccatccactacccaaatagcactctctttaccaacaccgctaatgtagatcgtgttggtcgccgcatcggcaaccagctcacggggctgtaacggacgaacctcttcagtacgtttgcgcgcatcaagtaccagacgaccttttacatcacccgttttggcatcaatcgcggtaactgcgctgttaatggtattgccaaaccacagcgtttgggtcgcggcattgatggtggcgccgaacggcttgagatcgttatgaatcgcttgcgtgatttccagcgtcaccgggtcgagacgataaactacgccgcctttatccagtttacggctttgcgatgtagccagccagagcgcgttttcttgctgactccaggccatctcataagcgcctttgcctaccgctttacgcagcatgtcttccgccgccagcgtgctaaatgaggatgcgacgaggagcgaacctaacaataaagaaccacgcaggcgcggcgaaaaaagatgacgtaagtgcatgacgactccttttgataaaaacgtgtatagctgcttcacactacttcgctgcgcgggatcttcgttccgcacttattataagttgagaataataatcattatttatcagaaagtggagcttttcctcgcctgcgaatgtcatggctcttaaataccgcacattttcttaacttaatgtgcgattaaaatttcaaaactttacatattgactacccttaatgtcacgttttccgttgatacgcttacatttatccggcattttcatgaaaattatttccgttagacagcgactttatcccgccctcttattgcctctgaccttctccccggtccttcaggccgccagcgcgcccaatgaacaaaccatgatagtcaccgcaacgccgcaaaccgtatccgagctggatacacctgccgccgttagcgtcattgagggagaagacatgcgtctggcgacgccgcgcgttaatttatctgagtctttaaccagcgtcccgggattgcaggtgcagaaccggcagaactacgcgcaggatctgcaaatctctatccgtggatttggctcgcgttccgcctttggcgtgcgcggcattcgtctgtatgttgatggcattcccgccaccatgccggatggacaaggccagatttcaaatattgatattaacagcatacaaaacgttgaagtgttacgcggccccttctcagcgctatacggcaatgcttccggcggcgtgataaatgtcaccaccgaaaccgggagacagccgcccacccttgaggccagcagctactacggcagttatggaagctggcgctatgggttaaaagccacgggcgcgatgggggacggcacacagcctggcgacgtggattacacggtatcgactacccgtttcaccacccacggctaccgcgatcacagcggcgcgcgaaaaaatctggctaatgccaaactgggcgtgcgccttgacgatgtcagtaaactttcgctgatttttaatagtgtggacattaaggcggacgatcccggcggacttaccgaatctgaatggaaagccgatccgcagcaggcgccgcgcgctgaacagtacaatacgcgtaaaaccatcaaacaaactcaggcaggattgcgttatgaacgtcagctcagcgcgcaggatgatatcagcgtgatggcctacgccggagagcgggaaaccacgcaataccagtctattcccctggtggcacagctaaaaccagcccaggctggcggcgtaattacactgcaacgccactatcagggaattgattcccgctggactcaccggggagaattaggtgtgccggtcaccttcactggcgggttaaactatgaaaacatgagcgaaaaccgcaagggttacaataatttccgtctcaacaacggcacccctgagttcgggcataaaggcgatttacggcgggatgagcgtaacctgatgtggaatgtcgatccttatctgcaaacccagtggcagcttacgcaaaaactctcgctggatgctggcgtgcgctacagttccgtgtggttcgattctaacgatcactatatcgcgcccggcaatggcgatgacagcggcgacgccagctatcaccactggctacccgccggatcgctaaaatatgcgttaactgacgcctggaatctctatcttgctgccggtcgcggatttgaaactcccactatcaatgaactttcttatcgcgctgacggccaaagcgggttcaactttgacctcaaaccgtcgaccaatgatacggtggaagtcggcagtaaaacgcggattggcaatggcttgttgaccgccgcgttatttcaaaccgataccgatgatgaaattgtcgtcgccagtagtatgggaggacgcactacctacaaaaacgcgggcaaaacgcgccgccagggcgcagagctcgcgttggaccagcgcttcgccggcgactggcgggtgaaagcatcatggacctggctggatgcgacctatcgcagtaacgtttgtcaggggcaaaactgtgatggaaaccggatgcccggcatcgcccgtaatatgggattcgcctcattaggttttatcccggatgaggggtggtacgccggaacagacgttcggtatatgggcgatatcatggccaatgatgaaaataccgccaaagcgccttcgtataccgttgttggactaaatacagggtataaatttaattacagtcagcttaccgtcgatatttttgggcgggtagataatctatttgatgaagaatatatcggttcggtgatcgttaatgaatctaatggccgatattatgagccagcgccagggcgtaactatggcgtggggattaatctggcatggcaatttgaataaatatccggcaatagcggggcatccccgctattgattagtcatagtttcatgaaagttacatgaagtactgatttttaatcgtcgctacgttttgttgcaaaacgttctgtaggcagtggcgactggcttctttatcaccagtcactaacgcattaagcaattttctgtacagattaacgccgttttgataatcatcaagtttaaaattatcatataaaaaatgcagacttggccccaggcgtacccataattgctcgatcatggcatacagcgttggcatatccgcgtagtggtagatctcaaagcggaatgcgcggttggccaaaagaattttctccataacgccactttccagcgcctgttgaaattcatctaatagcgcattcagcgtctgctcgcgatccggggtaatcttacccgcagcggcgaccaccgccatctcctccagggcagtacgaatcgtattaatttccagcaaactttccagcgagatctccggcaccataaacgcctgtgctggcgccaccgccaaagcactggaagagaccagccttaacagggcctcacgcaccggcgtaatactgacgcctaactcttgagcgatatttttagtgataagccttgcgcctggttttaatgcgccaatagacaattgatgctttaaccgattttcaacctgtgtggtcaggcttatatgttgtgttttttccgtacccggcattttccttccttcacctcttggcagaacaacatcgcaatcgagtcccgaagaagtttcggaacttaattgtaaaaaagataatccagacctgaacggccaaataaataaaagtgataatttacttgcgtgatattctcatcttttacaacaatacaggtttctttatggcaaccgttttatctccgtcattccttcatgtatcgagatttttgaccggttcaggccgctgagggagataagctgccccaccgcgatctgaatgatgaatataagtaaagccgcaattttaaaatttgcacatttttatggcgacataatgccgccattttttctttacgcatcgtccgctaaacgtatcacgactttgccaaagttcttccccgccagcagccctataaacgcttctggcgcattttccagcccatcagtaatctgctcccggtaatgtattttcccttctttgatccaacgccccatttcttgctgaaactcatgtatccggtgaccatagtcctggttgatgataaaaccttgcaggcgaatacgctttttaagtaatgtcgccatcagcagtggcagtctgtctggaccgtccggcaacgttgtcgcattgtagccgctgaccagaccgcagagcggaatccgcgccgacgtattcagtagcggtaagacggcgtcaaagactttaccaccgacattctcataatagatatcgataccctgcgggcaggcctgcgcaagctgttgtgggaaattatcagcgtgatgatcaaggcacagatcaaatcccaaaacgtctgtcgcatgacggcatttttccgcgccgccggcaatacccacgacccggcagcccttcagcttgccaatttgcccaaccgttgcgcctacggggccggtggcggcggcgacaaccagcgtttcgccctctttcggctggccgatatccagtaaccccatataggcggtaaaccccggcatccctaaaactcccaacgaccaggaaggatgttgcggattatcacccagctttaccaacccttcgccatctgaaatgtcataatcctgccaaccattgtaactcaacacccattcgtctggtcggtaatcaggatgattcgacgcgacaacgcgactgaccgtaccgccaaccataacgcagccaggttcaactggcggcgcataagagggttcatcgctcatgcggccacgcatataagggtcgagtgataaaaaaacggtacgcaatagcacctgcccttcaccgggcgtcgcgacgtcatcttcttcgaggcggaagttatccatctgcggcgcgccgtggggacgcgaggccaaaacccaacgacgatttcggttggtctgttgcttcattctattctcctcatgcctggcataatccatcaataatagtcgaacattagctttctgagggagttaaacactctcagatatcaggctgtgcgcttttatgaacgactttctttcccctctcgctaaatatgaattcttgcgctaattcgttgatttatgccgccttcaatagtatttctaacactatcgtaaacattccctggggttccctatgacgattcgctttgccgataaagcagactgcgccgcgattaccgaaatctataaccgtgcggtattacatactgcggccatctggaacgatcggacggtcgatacggataatcgccttgcctggtatgaggcccgtcaattactgggctatccggtgctggtaagcgaagaaaatggcgtggtgactggctatgcatcatttggcgattggcgcagtttcgacggttttcgctataccgtcgagcactcggtttatgttcatccggcgcaccaggggaaaggactggggcgaaaactgctcagcagactgatcgacgaagcccgacgctgcggcaagcatgtgatggtggccggtattgagtcacagaatgccgcctcgatacgcctgcatcattcgctgggatttaccgtcaccgcgcaaatgccgcaggtcggcgtaaaatttggccgttggttagatcttacgtttatgcagctccagcttgatgaacacgccgcgccggacgcctgctgatgaaccagtcgctgacgcttatctttttgatcgccgccggcgtcgggctggtggtacaaaacagtattatggtgcgtattacgcagacatcatcgacgattctgatcgctatgctgttgaactcgctggtagggatcgttttatttgtgacgatattgtggtttaagcaaggcgctacgggcttcggcgagctggtcgccagcgtgcgctggtggacattgatccccggtttgctggggtcattttttgtatttgccagcattagcgggtatcagaacgttggcgccgcgacgactatcgcggtactggtcgccagtcagttaatcggcggactggcgctggatattgcgcgtagccacggcgtcacgttacgcgcaatggtcgggccggcgtttggcgcgctgttgctggtcattggcgcatggctgattgcgaagcgccagttttaatgggttacaggatcgtgccgcctttggtgagctgttcgcggcgcgcgtcccgatcttcttgatattgcctgccgtgatgcgcgatagccgtgcgtaaacgctgctgctgcacataacgatcttcgtgacgtaattcagcgtcatcgctcaaggcaatcagcaattcattcatatgggcaattacgctctccgcgatggcggcatccacgcgggcgctcacttcctccaggtgcgacataagctctcctactctttattctgtaatagcatgattcgcctattatacgcgttattgtcgcccgatgcggtcattcgccgccgccactctgatttaacttacgtcaagtgaaaacacggggcttaatagaccgagaattcgcgcctttttgcctttcttccgccgtttgcttgcgtatagaccccgtaaagtagacgcgtgaagaagtctaagggataacaacgtggcaaaatctctcttgcgcagcggcaatctggatgattatcaggccgtgggcggcggcggtcaggccgtatttgaatcagcattgcaaattcgcgaaacgcttcgtctgcgtaaacagcagacgatggttgactgtctggcgattccgcaacttaacgataatggcgatcgggttgactggtattcgccgattgaaggtcaggcgatagcgtggaaagcggctgacgaagagacacgttctcgggctttacgttatttagccagcacttttgaaagcgcggctgcactcagtcgcaaaagtctgcaatccggtaaaacagcgctccagctatttggttcgctacttgagaaggcgacgcaatttcccggcgaaaatcatgttttcctggttaacggcaaaccggttatcaccttctggggattcgttaatctcaacgaaaatacacgcgatgatgtgctggactgcctgcgggtaaccgaggcgatctccgacatccctctggtcgagccggagccgcagcccgaagaaaagccgctggtagaggcggcgtttagtcaggcggatgaacctttgttaacgtctgtcattgagccgccgaaaatgccggaggaacctgctgcgccgcccgttatcgttagcgagccgaagcctgccgcacctatcccggttgctgaggcgaaaagagctcgccgtctaccgctgtggagcttacctgtcgctgccgtggttatcgccgccgtcgccacgccttttttctggccatcttcatccgttgacggggcctctcctgttcgcaccgcgcctgtcgctaccgcgaaaactgatgttaccccaatgcctgaactcaccgcgcatttgccgctgcatcgcgctgaggtgacgtccgcccccaaagcggcgccgctgccggaagcgcctgttatcattgccgctatccccaaagacgcgctggtgatggacaatacgcagatgaagcttggaaccacgcgctttttaaacggtagctggcgggtcagcgtggatgtcaaagatccgattaccggcaagccgccctctctgcgttatcagatccaaaataacaaaggcatcgcgcgcgtagtacatggcgataacgtggtttgtcgggcggaaattttctctggtctgcatcaaacgggcgagctgatgattaaaagtcgcggcaatgcgcgctgcaccgacggttcacgttatccgatgccggaaattacctgtaaagcaggcgtcaatgacgtcgcaacctgtaccgcccgttatggcgaccacgcggcaattccgttgacgtttaaaaagataggtgcctgattttatgttggtcaatctgtgtgattacaaacagagcgtcacgctcattgcaaacagtggcgtccagtttcttgattttggcttaacgccgcaagagtcggcccactacggacgttttgtgcgcaaaacggcaaacggcccgctactgcgcctcgattttgatctgaccagcgggcgctacacgttgccaggacgtgctggcggccaacccgaagtcgtgaaaccggaaagcactcagacgctgcactattctctggatgtactcgacgggatctggcttcccctgccgttcctgcgttttaatccgccgcgtacctttattgacgggccggataactgggcgcgcattcaggtacgtaaactcagcgagccagatagcgccggaaacacacaccgcatcaccctcgccttcgacagtcagctggcaaaaaatatgcctgcggcgttggcgccttgcgaaaacgatctgctcaatggcacacgttttgcgctcgcctggcgcgatgaagaagttgccgattttcttgaccagacatggattgacggctggctgcgcgagtcgtttcttcagtatgcctcacaggtggaaaaccgtccggaacaggccattcaacaagcgctgcgtagttttgagtatcaggcgcactggttgaatttactgacgctgttaggcgaacagcttacggtgccggaagtaaagtttgtgacacatacgttaagcacgcccgcaatcccggtcgatctgattctggatgtcggcaatacgcatacctgcggcgtcttgatcgaggatcatggcgatgcgaatgacggcttacgccagacggcagagcttcaggtgcgttctttaagcgagccgcagtatctgaacgatcctttatttaccagccgggtggaattctcagaagcgcgctttggcaagcaacacttttctgtcgaaagcggacgagacgacgcctttgtctggccttctattgtgcgtgtgggcgacgaggctcgcgcccttgctatgcagcgtgtgggcaccgaaggcagcagcggtatctccagcccgcgccgctacctgtgggatgaaacccccgccttgcaggactggcgctttagccagatccacggtaaaacgcagcgcgaaccgcttgccaccgcgtttccgctgatgaatctgatgaacgacgacggacagccgttattccgcctgccgcatgaagaaaggctaccggttttttcgccgcaatacagccgtagcaccttgatgacgcatatgttgtgcgaaattctggctcaggcgctggggcaaattaacagcgtcgccacccggctgcggctcggctttcccgcctcgccgcgccagctacgtaccctgattttaacgctgccttccgccatgccgaaacaggagcgagaaattttccgccagcgaatgtttgaagcgctggcgctggtctggaaagccatgggctggcatccgcaggatgaggatttcaccacgcctaagcagcgtgaaaaaagcgtggtgccagtacctgaaatacagatggaatgggacgaagcaagttgtggccaactggtatggctttataacgaagccatttcgcattacgccgggcgtaccgaatccttttttaatgcgctggccagaccggatcgccagcctgaacccggcgtcgtccccggacgcgcgttgcgcgtggcatcgattgatatcggcggcggcacgacggatatggcgatcgttcactatcagttagatgacggcgtgggggccaatgtaaaaattacgcctcatctcctgtttcgcgaaggttttaaagtcgccggggacgatctgctattggatatcattcagcgctgcgtactcccttccctgcaaacggcgttgcaacgggcaggcgttacggatgccgccgccctgctggcgaccttatttggcgattcgggacgaattgatactcaggccattttgcgccagcaaacggcgctgcaattatttatgccgctgggccacgcggtactttccgcctgggagcaaagcgacattaacgatccgtttgccggtttacatgcgacatttggcgatctgctgatccgccgcccaacgagcaacgtgatgaactatatccagcaggcgatcgatcatgccttaccgtctggttcgccgacatttgatatattcaatgtgccattgcaaatccagtttagccagcttcaggaggctctgctggccggtcagtttacgctgacaacgccgcttcatgcggtctgcgaagcgatctcccactatcactgcgatatcttgctggtgacggggagaccgacctgtttacctggcgtacaggcgctcatccggcacttacaaccggtgccggttaatcgcattgtgtggatggataagtatcaggtacatgaatggtatcccttcagtcaacaagggcgtatcggcaatccaaaatccactgccgcggtgggcgcgatgttatgcagcctggcgctggacttacgcctgccgcgtttcaattttaaagcggctgatatcggcgcgtattcgactgtgcgttatctcggcgtactggataataccgttaatacgcttcgcgatgaaaacatctggtatcacgagatcgatttggataaacccggcgcaacgctggacgcacgcctgcattttccgctacgcggcaacgtgacgttgggctttcgtcaacttgcgaacagtcgctggcctgcgaccccactctattgcctgagcattaattccgccgaactggcgaaaaccatcgctggcgacggcgtactgaatgtccgactgaaattacgcggcagtagcaaagatagcgccccggaatcgttcatattaagtgatgcctggctccaggacgggacgccggtcgccgccgatgcgctgacattaaaattgaatacgctggctgaccgccgccacagcggcagccactactggatagatagcgggagtgtatacctgaaatgacaaaaccgttaaacgccactcaggctgttatcgagtgggttaacaacacgcgccgttacgcaacgcgactggatgacgaagccgacgctctgctggcgcaacttacgcttgccgcggcggatgagtcagcgctcaacgccgcctgcgcatcatcacatggctgcgttggtctgtacgggtatgcgcaatccgcaaaagcgcatctgttaacgacgctatgcggtaacgagaatggcaagctggaaattatcacgccggaccgtgactatgattatttcagccacatcaatccgggtcatgcgccagcgaatatggctattcgctttacgcgcgacattttttcaaacgagagcggctggccgttgcgcctgcgcttgatcagtgaagccgaactggtgcagatctttattgcctggaccagctcgtcccccgtttgtcgccaggtcgaaaaatccattatcacatcacgcctggagaaatggcaatcgcttcgccaaccgcagcccgtccccggcgttaccgctgaagaggtagcgaccatcgcgagtttctggcgctcttgcctcccgtccgccagacaacatattgatgatgcgacatggcaacactttgcctcgctcttgcctgcgctggatctcacgacacgggcgcacgcctgggcattactgtggggagagcaaccagagatcacccagcaatggctggcgctggcgcatatgttgcaacaaaccggccatgccggggaactggcggcgccgctcagcctgctggtcgatcattttggcttaccggcggaaaacttcctgacgcaaatggcgctaaccgccagcgatacgcaaagcgatgtggtggtgcatccggttaaggaaggccgactgctcaatgcggtcagcctttcgcttgattctctggcgctgcttacccgcgaactggtgctaaccgttgaaaatagcgtactggataacgttgatttactggatattccggtcgcgccagacagtcatcctcatccgttatggcgggcgaaattaggctggatgctggcccattaccgtcagcagatacagcccgatgttctggtgatttgcaatgctctggcatctcgctcgcaaacgtccactgccgcccgtcacttactggagtgggttaacgccacgcagccgcagcatgaatcagcgttacccggcgtcgtctgggctattactccacaggatgcccgttttgccacccagcaaaatctggatgaagccgtccagcagttgatgggtaaacctggcgtgcattggggaacgttgcaggcgctggataaacacagtatgcagcgtttggtggagtggttatcgcaggcgacatcggcaccacagcgacaggcgcgcttacaggcgttacgcgaacaactgcgaggccgcgtgcgcgatctgttaccgatgtgtgatgacgcgcggctaccggttgaaaccgtgatccggcgtcttcaggcccaggccgccagacatggcgacctgctggccgggctgttaccgccggtacagaatttcgaagcgttgctgcgcacccgacagtcgcgagaagaacaggtcagcggtttatttaatgacgcgatcgatctctttgccgacgaaccaacgcacgcttcagcgtcagaaggtcatgaaacaggctaccaggcgcacaaaatgtggatcaatcatctgcgccagtgggcccactgccgggataatgcgcagcgtctgggactggaaccgcagatgctcaacgccgtggcggagattttaattaccgccagctatcgcctcggtttacctcagcagttacagaaaaccatgcagcgcgaggaggtgagcggcgcgcagcttcatgccatcattggtaacttcatcgcctggctcggctacgccaatatcgaggaggcccaacgcccggccagccgcgttcagaaaggcgcagccattttcgccgcaacgccgcgttcgacaatgttgcgtctaacaaagcttgacgaacagcccgttcacgccgccagccgctatgtctatgactggcttgttgcgctgtataccctggccaatgagaacgcaggatatcggcatccgcaggacgttaccgacgtagacagagcgcaattaattgccctgatagcctgacctggcggaaaaaccatgcccggtaacctgtatcgggcttgaggtcagaaaagcgaaaacagcaatgcgacggggaaacttatcggccatgtcgcgccaaccagaggaaaaaacgcgcgcaatatgctctttttatttgacacacatcaaggtttatcagccttaacagcaaaacgttctcaatgcacggctccgctcacagaatatcctgtttacgtattattgcggatctcgccaacccgtactatacccataggggttatgatgaaaggtggcgaaaatgaatgtttccagtaaaaccgtcgtgctgattaatgtctttgctgctgcaggacttttgggtctgatctcgttgagattcggctggtttgcttgaggtgttcaacctttgagtacttgctgcgcatgttggcggggaggtccccctctccgccgacacccgcctattttttcacgatttttctgaacagtaaatgatccttaatgcttaaccatgatgtggcggacaagggtgtagtcttccagaccatacaatgacatatctttgccgtatcccgactgtttttgccctccatgcggcatttcgctaaccaacatgaaatgggtattaatccaggtacagccatactgcaatctggcgctaagccggtgcgcccgcccgacgtcctgagtccagacggaggatgccagaccatagcgagaatcgttggcccacctcagaacctgatcttcatcatcaaagacggttatactgaccaccgggccgaagacctcgcgttgcacgatggcatcttcctgttttgcgtctgccagcaacgtcggagcgaaatagtaacctttaccttccgtttgacttccaccagtaatcacacggatatggctgagggccttcgcctcctctacagccgctgtgacgcgcttcaggtgcgccagcgaacttaacggccccagctctgtcgacttatcctccggcgcgcccattttcaggctgctcaccgcgttccctagcttttcgaccagcgcatcatagataccgcgctgcgcgtatatacggcacgccgcagtacaatcctgtccggcattatagaaaccgaaagtccggacaccctgcgccaccgcatccagatcggcgtcatcaaaaacaatcaccggggctttaccaccgagttccatatgcgtacgttttatcgctggcgcagtatggcgcagaatatgctccccggtcgcgatagaaccggttaaagagaccatgcgtactttttcatggccggtcaatacatcaccaacagtttgccctcgtccgaacaggacattgagcacccccggcggaaagatatccttcgccagcgcggcaagtttaagcgccgtcagcggcgtgatttcagaaggcttaatcaccacgcagttacctgccgccagcgctggcgccagcttccaggccgccatcatgagcggataattccacggcgcgatagaggcaaccacgccaatcggatcccggcggatcatcgacgtatgtccttccagatattcgcccgccgccagcccactcaaacaacgggccgcgccggcaaaaaagcgaaagacatccacgattgccggaatttcatcattaattacgcagtgcaaaggcttaccgcagttttgcgattcaagccgggcgaactcaagggcgttttgctcgatgctgtccgccagttttaacagacattccgcccgtgctttgggtgtggtctgcccccattcggcaaacgcgctatcggcggccagcactgcggcgtcaacctgcacgggcgacgcttccgcaatctcaagtatgacctcgcctgtcgccgggttataaacggactgcctttctccctcgccgtccaccagcacgccattaatcagtaattgatattgcatagcattttcccatatcgtcattaatcgatttccggcgaacgggccgccgctttcctaaaaatagacggcgcgccagatgctcacccggcacactcgggaaatttagtcaggttgtgagctgacacgcattccacctcacacaaggcttttagcgctcagcatctcgcgaatcaggcttccaagctgttttacggcctgttcttcccgttctccccaatgccatgcggtgttaaaacgaaagaaacgcgtccaggcgccggacgttgaaaacattttccctggcgcgatactgataaggtgttcaagcgctttggcgctaagttcgccggcatcaagctgctcaggtagctccagccaaagaaaataaccgctatcgttatggtgaatttttacttccgccgggagatggcgcaaaagggtttgccaggcttgctgtttacgttcggcaagctgccttcgcaatcggcgcagatgcgcgtcatatcgacgtgtcgagagataatctactaacgccaattgcatgggagaactggtggataatgtgctcattaactgcaaacgctgaatttgtctggcatggcttcctcccgcaacccagccaatgcgaaaaccgggaaccagacatttggaaaaagacgaacaatgcaacacggtatcgtcgcgatcccatgctttggcaggaagaggtttctcgcggccaaagtagagttcgctataaacatcgtcttcaattagcgtcacgttatggtgcgtgagtaacgcaaccagccgcgcttttttctcagcactcagcgtgaaccctaacggattctggctgttggtcattaaccagcacgctttcaccggatattcctgtaacgcctgttccagcgccataagatcgataccttctttaacatcggtaggtatcgacaacgctttcaggcgcaatcgctccagggcctgtagcgcaccgtagaaacaggggttctccaccaccacccagtctcccggtgccgtcaccgcctgtaaactaagattcaacgcttccagcgcgccggcggtaatgacaatctcgtcaggagaaacggtaatcccctgctgcgcgtaacggcgtgctatcgcatagcgcaattctgcattacctggcggcaagttttcgatgacgctcattgccgtctcggttttactgacctgcgccagagagcggttcaattgcggcaagggaaacagacgcggatcgggaaacgctgaggcaaagggcaccacagaggtatcacggctcgcctgcagcatctcaaaaatataggtattgatatctacggcttcatcccgaataacgtgcgctgccgtcgcgactgaccgacaaaccggatgcggcgcgacataataaccagattgcggacgggcgataatccgtccctgactttccagcaactggtacgcatgaccgacagtcataaaactcatgccgctactggcgacctgctccctcagcgagggtaatcgatcgccgggttgccaaacgccagaggcgatttgttctctaatttgctccgccagacgttgatattttttcattattcgttctcattgagcgctgcttgcaggtggcaaccgcagtgtatatcagttgttaaaattaacaatgatttgctaactgttatggtgctttccaacaggcgtaatgattagatttcgcaacaaaacgccgtttcagggtctctgcttaacgggaaagtcaaaccaggtgttcgggtatggttcatgagtaagggagaagtgccaccattcagtatccagtggcgtaaaacccgcatcacgcatcaatgtttgtaataacaacctatttgcgcgttgctgagcggtaagcatgacattatcgggatgggataacggactaaaacagtcaaagcctgtaccaaaatccagactattatctggcgagcgttgcgccgcggacgcagtacaattcaccagtggtcgtccgggatggtatatcggtattttactgtcaagtggaacaatcgttagatcaagcgtacttccccgactgtggccggatctggcggcaagataaccttcctcaaacaaacgatttttctctacctgcggataaaattcgtttttcatttggttttgagaaggatctttggcccacgcgataaagtcattcactgcgctttgcggacggtagcaatcatatatttttaaggtaagtccgaaggggcgtaaacgatcggcgacctgctttactgcgttcgcggctggtcgtgttaacaggcaaacaggcgcgttatagcctttaatggggcgaccaataaagttatgggaagtgaagtatcgcatgtctacctgtacgtcgggggcgaccgtagtaatatcgacaaagtcttttggctggtggagatcaatatggttttcagctgatattgcctgaacggacaacaggctgaacaggaggaaagaagatacgcattttaccatatgttacacctcgcgagagtcacaggggtgattatgtatttgagcaggtaaagattagcggacagcgcttaaacagatggttaaaataaacatcattccccccctgtaatctgtgccttattacaaacggagaggttatattttgcttattatggccattacgccgcctgttctatacccaaaataattcgagttgcttaaaggcggcaagggagtgagtccccaggagcacagataacgatatgttttcacaaaggcgagtctacctgaccagaaaggatatttgataatcaatagtacagttgttgtcgccttccataactaaataacattgtttcgccaaagataagaccactatatagtcaggaaggcaattagtgaggaacacgtcgattgtcggcgataatgcactgaaattacgattcactgcagttgtgcaaacacatagaatccccctcgaaccgagataattcggtctgctggtcatagccattattcagtaagaccgcaggttgcagcggcggatcacgggcgtgaagaaaaatcctgtgccccaaattttttggacaagcgctgaacctgccgtatacttttacttaacgtacactccgccataaaaataaaccctgcgatgataccgtaatgccacaggcataacttaaggatatgccataaatcaagcgaagcatgatttaacttctcagtaattgcgatagtctgtacaaatattatgggatgaaataataagacgcctaacaaaaatatccctgccacgatcatggcaagtaactggaaaaaagcccatccgataacgaaacggtaaagtaacagcaataatagccgtccacattttcttagccattctgactgcaaaatgccccaggatgctgtcttttcgtgaatttcaccatctgatttcttcattttgagcctcctcgcaggtttttataattttatcacctaactggaaataaacccgtcagctaatcgttacaacaaatataattaagacaaaaactaaagagtaaaggcatttatatcataagtactatcagcataggcctcctgccctgccgctaaatatctcattgttgttagcctaataatactttcagtttaacttcttataagacaatttgtacacggttgagcaacaatttactttctctaaaaataatatagcgtgtaattaaacattactcatggtatatgatgatgtgagaattaagaaaaccattttactttcattcgttttacctgacatacttcatggccaggaggcgtggactgactaaagccacgggtcgattttaacaataatgttgacggttcaggacaaagcaaaaatcaggtgtttcaccgataggcaaaccgatgggcaacatgggataatatttcgaataccacctattccagtaatgaagtatcatataatcacttgtggtctacattatgccaattactatcgggagaggatttttaaagagtgagatgttttctcaaagtgctatctctcaacgctccttctttacgtcactatgggaaaagattaaagattttttttgtgacacgcaaagatccactgccgatcaatatataaaggaattatgtgatgttgcctctccgcctgacgcgcaacgtttatttgatttattttgcgcgttatatgaattatcatcaccatcatgcagaggaaatttccattttcagcactataaagatgctgagtgtcagtatacaaatctctgtattaaagatggcgaagatattccgttatgtattatgatacgtcaggatcactactattatgagataatgaatagaacagtgctctgtgttgatactcagtctgcccacctgaaaagatattctgatattaatataaaagctagcacttatgtttgtgaaccgctatgttgcttgttccctgagcggttacaactctcgctatccggcggtataacattttccgttgacctaaaaaatatagaagagacgcttatcgccatggcagaaaaggggaatttatgtgactggaaggaacaggaaagaaaagccgccatctcctccaggattaatctgggcatcgcacaagcaggtgtaacagctattgacgatgctatcaaaaacaaaatagccgcaaaggttattgagaatactaacttaaagaatgcagcgtttgaaccaaattatgcacaaagctcagttactcaaattatttattcatgtttgtttaagaatgagatactaatgaatatgctggaagaaagttcctctcatggcctgctatgtttaaacgagcttactgaatatgtagcgctacaaattcataacagccttttttctgaagatttatcttcactcgttgaaacaacaaaaaatgaggctcattaccagagttgaccacaccataaatagtatggatttacaatcccctggcaataccaaaaccatctaatacaatacctttaaaaatatgcttccagggaataatggatttactatggaacgaattggctcgttatttttataattgacatactgagtataaatatattttctcatacaacttatcgcacttattgacaaaccgttttcgctaatttgaagtgttgaataataactcaaagaaattattggcatcatagcctcacgacgtaactggaaggtggcatgatgcttacaaaaacgttatcagtagttttactgacctgtgcgctattttcaggccagttactggcgaaacagcaagaccacgcattcgtatggtttgcgacgggagggcaccagcttagacacgaagccgacagcgatgaattacgggcggcagcggaagaatccgcggaaggcttgcgcgagcaccacaactggcagaaatcgcgcaaaccagagagctattttcgttaattaaacgcccctgcgcttcagcagcgttttcatcagcgcttcagggctcactgaagcgacaacgctgccgggctggggcatttttaagatgtggtttttaattttgccaatgacatgcatttcgcaagggcggcagtcgaattttagcgtcagtacctcatcaccatgcaccaactgcatcggcgtggctttccagctcttaatatttcctttcgcctgctttggacaaaggttgaacgcaaaacgcaggcagtgtttggtgatcatgaccggtacctcgcccttctcctgatgcgcctcataggccgcatcaatcaattgtacgccgtaacggtgataaaattcccgcgctttgtggttgtagacattagcgagaaagctgagatgcgtttgcggatagacgggcgcaggctgcgccacgggtttccgacgacctcgttgataatgggccagccgcgccgcgtcaagcatatcaatcgcctcccgacggaactgattgagcaggctatttggcacgaacaacgccgccggtaatgtcacctgcatatcacgcgcgtagtaaagcgtttgtcccagcttcgccagtccggctgttaggttattcaacgctttttcagagttgttggcttcctcaaataccccgtcaagcgtatgcgtgatgcagacaccgtcttcactggtcagtgtcagaataagctgttcctgccagccgcccagcatgatatcaaccgccacacggcgctcactggaggtttttgtcagcgcttgctgccagttatggtccagattacgattcaacggatgatgcggacggactttatgcaggtcggcaggcatatcatttggccaaacgcggtagcggttatgaccggttttctccaccgtattggcgcgaaaacccaccacttcacgcttaatcaacacgttcagaccatcgccattcgccaacggctccgtcgcttctacgtcgagataatccttcgccacattcagcacctcgcctaccggcaagccaataaattttggtgaatcaaatgcgccaatatcgcctttacgcgcgttaacaaaatagtcggtgctgccgcgatggaaggttttctccgtggagggaacaaaaaagtgctcggtccgaccaaccgatgcacgcgccagatcgccacgttgctcgataatcgcgtccagcatctgacgataatgcgcggtgatgtttttgacatagctcatgtctttgtagcgcccttcaatcttgaaggaacgtacgcctgcatcgatcaacgcgccaaggttagccgtttgatcgttatctttcatcgatagcaaatgtttttcgtaagagaccacccgcccctgatcgtcttttaacgtatacggtaagcgacaggcctgcgaacagtcgccccgattggcgctgcgcccggtttgcgcatgagagatataacactgtccagaataagcgacacacagcgcgccatgaatgaagaactcaatcgtggcgtcagtagcctgatgaatagccgctatctgactcaaattaagctcgcgcgccagtacaatctgtgaaaaaccgacatcggcaagaaacttcgctttttccacgctgcgaatatcacactgtgtactggcgtgaagctcaatcggcgggatatccagttccagaatgcccatatcctgcacaatcagcgcatccaccccggtattgtacaaatcggtgattaaccgctgcgcgggctccagctcatcatcatgcaggatagtattcagcgtgacaaaaatcctggcgccgtaacggtgagcaaacgggaccagatcggcgatatcgcgcagactgttactggcgttatgacgtgcgccaaaaccgggtccgccgatgtagacggcatctgcgccatgcaaaatcgcttcgcgagcaattgcggcgtcacgggccgggcttaacaattcgagatagtgaggttgctggcgcatacagtctttcttatccaatagcagcgaaatggcggctattgtagtcagaagcgcaaactaacgaaatagttttcccgcttaatcacgtgggtaatggatcagcgagtgaaaatgaaccgtctggtcactactgttgcgataggtatgcgccgtatcgccggcaaaacgcaaacctttaccggcgtctatggtttgccataccccaccagtacacatgtccagccgaccctgaatcaccaccacatgttcgataacgccggctttatgcggcgttgattcgctgaccgcgccaggcgccagcaatagggaaaaatagtcaaaacagagttcagggtcccacggaaacagcggtgtgattaccatcgcttgctgctggggatcgaaggttggaggaaattcggcctgcggcggcgaaataaacattgagaatggaacgttcaggcccgtcgcaattttccacagcgttgcgactgtcggactggattcattacgctctatctgccccaacatggcttttgagacgccggagatctccgccagacgtgataaactccagcctcgctgatggcgtaacgttcttaacgtggtcgccagatagtgtgtcaggttatccatttttcccccctgtaaggccatagcgtatcacttgtacgctataacgcacaatgctacattgactgaccgttataacgcacaagaggcgatcatgcgtctgttatcactgccgttacctactgtattatctggtctggtcgccgttctggtcggctatgcaagttccgccgccattatctggcaggcggcgcttgccgctggcgcaacacccgcagagatcgccggctggatgaccgccctcggtatagccatgggcataagcacactaacgttaaccttgtggtatcgtgcgccggttttaaccgcctggtcaacgcctggcgccgctctgttggtgacagggcttcagggattatcgttgccagacgccgtgggcatattcattgtcgccaatgccctgattgtgctgtgcggcgtcacgggattgtttgcgcgtttgatgcggataatcccccattctcttgccgccgcaatgctggcgggaatactgctacgcttcggcctgcaggcgttcgggacgctcaacggagagtttgtcatgtgcggcggtatgctattggcgtggctactctttaaagtattcgcgccccgctatgccgttattgctgccatggtgatgggaataacggtggcgctcatccagggtaagatggcgatgagcggtattcatttcgcgccggtgtggcccaccttcgttcccccccacttttcattcgctcaaagcctgagcgtcgcggtaccgctcttcctggtgacgatggcatcgcaaaacgcccccggcgtcgccacaatgaaggcgtctggctatcagcttcctgtctctccgttaatgatttttaccggattactggcgctgctgctttcgccgtttggcgtttattctatctgcattgccgccattacagccgccatttgtcaaagcccggacgcgcaccccgatccaacgcgtcgctggttagcggccgccgccgcaggcgttttttatttacttgccgggtggtttggcggttcgataaccgagctgatggtcgccctaccggttagctgggtgcaaatgctggctggtctggcactgttaagtacgattagcggtagtctgtatcaggcgcttactcacgaaagtgagcgtgacgcggcagttatcgcatttctcgtcaccgccagcgggctaacgctgatgggcatcggatcggcattctgggggttgatcgctggcgggataggctacgcaatattaacgagaacgcgccgcccgtcgttgtctggctgatggcggccgctaatctgccggggtttgcgccatcttgcgatggcgccgcagaattattttttgttagtgtcaaacatagaggtatccgtcgccatatcatccacaacctgtttcaacgtctcaaacgccattggcgtactggaattactcaggtctttaccttcgccctggcgcactaccttgacgaccggcttgttggtcgcggcatctatcagctcaccctcaaaatagaggtgggtatccatggtccggtggcccgtcgccatttgcgtgcccgccacaatcagcgctacagggatcacctcatagaattgcagcccttctttgctggtatccacgcccgtaatcgcctcgcggaaaatcaaactgcgcggccctgccgtcgtgaccagcggtttgcgctgttcaattgctgattttactttagtgttcgtataagccagcagtttatcaagaacttgctgtccgacctgggtcgttggcttggggatggggtaatatgttatcggattgtaaacaatactgtcatagttagagtcattaaaatgtggatctacccagcgcaacaccggtttccccgtggcggaagtagtctccttcaggtccgaataattttttaagaatccagaatacttatccggctgtgtgactttagacgcacagccggataacgccagcaagccagtaagcactgcaactttaaataaagtatgagtacgcatgaaacgatccctttagtcttcgcaatgatgcaaaggaaataatagcaaaacgaaatcattctggatgcactaaaaatggtaacgacagcacaatttgaacgcggcgcccgacaaaaaaatgccgaacgcagcaagacttacagaacttgcatcgctcaggccgtttttctcgccagcatcgtagcaaagcgcagtttgatacggttgccgttttcgtccgtgcggtgaagctcgccgacatcttcgttgtatttcagcatgtcccatccttcgtaatagcggcgtaattcgccttctttaaaagcgaacgggaatcccaccgtacagggaaagcccggcgtatccattgccgcaacaatcaaattatacccgccgggttttgtgcagcgttgcatattggcaattaaaccgggaatggtttgcgcctcaagaaacatcataaccactgtcgagagaataaaatcgtattcgccgtcaaaggtcaatgtattcagatcgacaaggtcggtttgcagattatccagcccttctgccgctttaatacgctcaaggttagccatactggccggatttttatcccacgcggtaacgtcataaccgttcgcggccagatacagactattacggccattgccacatcccaaatccagcgttcggcctggcgcgacaacctttgccgccgccagcacatccgaatgcgtgcgggttaaaccgtatttctcagtaaagtaattttcgtcacgaacggtcatttttttcctccgttttcaacagtgcagcgcgctcagtgcgaataagcaacgtcccctgcaccagcaatagaaatgtacgaaccagcaataaggcgataatagcgttagtgaaaataaacagcgggacggccagaatatggaaaaaccctgattcactaccgtgaccaagatgtaaccccgtggtcgtcagcgcggaaacgccgaacgaaaaactccagaaggaagcattaaacggttgtgataaataccagggcattaatcgcagcataaataaaagctgtaacagaccgtagccgaatagcattttcgccagcgtgtcgccctccccgccattgacgctcagccaggcgctacaggcgaccagcgcgggcgccagttggatacccagcgacatacgcagcaccgccggtaattcgccgcagctacgcagtcgctgcaaaataaccggttccagacttaaccacgaaaagacgcctgcgcctaaaaacaccagtccggcatcattgtaaccgagcgctccacaggccatagcgctgataaaattattcgctaccgtgggcagataaagtcctggggttgtcgcttcttccggatgcgctccgcgccaaagacccgccgtctgccaggcggcatacgccagttgtatgacgacccccacgctgaatagcgcaacggccaacgggcgataccagggaacgaaaccgatcgcgaccagcatcgtggtggcgggaaacaggctgacaaaactgctcattaccggatgtcgcacttcagccatcacgctatggggaaagcgcaccagacggctaaggaacgccagggtcaagagtgcccaaataatcatcgccaggatcaccatgatgtcgccgggccagtggcttattgcccatatctggctggcataacgccaggcgaatcccataccgatagtgccaaggacgatgccaaaatagcccgcaggcagattgagcacgcgatcgctctgcttgtgattacacattttgtttaatttataaagtatatttgaaatgcattttatggaatttctggttgtttcgccagtacctttgctacggttatcttaatcgttcacacggaatttccctatgatcaaatatcgactgagtgaagaacctcgtgcttttacttatcaggtagacggtgagaagaaaagcgtcttattacgacaagttattgccgtaacggattttaacgatgttaaagccggaacctccggcggctgggttgatgccgataatgtgctgtcacaacagggggattgctggatttatgatgaaaacgcgatggcctttgcgggcacggaaattacgggtaacgcgcgtatcacgcagccgtgcacgctctacaataacgtgcgaataggcgataacgtctggattgatcgcgctgatatcagcgatggcgcacggataagtgacaacgtcaccattcagtcctcttccgtgcgtggagagtgtgcgatttatggcgatgcccgcgtgttaaaccagtcagaaattctcgctgttcagggactaacgcatgaacatgcgcagattttacaaatttacgatcgcgccaccgtgaaccattcgcggattgtccatcaggtacagctttatggcgacgccactatcactcacgcttttattgagcaccgggcggaggtctttgatttcgcgctcatcgaaggcaacaaagacaataatgtctggatctgtgactgcgccaaagtctatggccatgcgcgggttatcgccggcacagaggaagatgctatccctacccttcgctacagctcgcaggtagcggaacatgcgttaatcgaaggcaactgtgtgttaaaacatcatgtgctggtaggcggacatgctgaggtacgcggaggtccgattttactggacgaccgcgtgctgattgaaggccatgcctgtatacagggcgaaattctgattgagcgccaggtcgagattagcggacgggcggcggtgatagcgtttgacggcaatgctattcacctacgcggcccaaaagtgatcaatggagaagatcgtattacgcgtacccccttagtcggttctctttaatccgcatcaataatgcgggcatacatattaacgtcgtgatagtcgccgttaagatactccgcctgtttcatacagccttccagcgtaaaatggttgcgccgtgcgaccgcgttactggcctgattatcaacgcggcatttaatgacgaagcgccgaatatcgccgcgccgggcataatgtgtcatcagcgcctgtaatgattgcgacattatcccttgcccctgaagggactcatccagccagtaaccgatataggcggctttgtttatcggctcgatggcattaaatgagagtacgcccgccatctcatcctggcagaaaatcaggtacattttggcgtaaccacgctggtgcaacagcatattaccctgcacatgcttacgcgtttcctcctgcgacgtgacatattgcggccagtcgagcgactgttgtagccacgctttgtttttgagtaccagttggtgcagcgccggaacatgactttcatctgccgctcgcagttccagcgtcgtgctaacaggaataatttccaccatcgcgttgcccttcttcgttgttggtcgtgatcacataaatagcctggtttaccgataacccgcaggtgatatgagcgtttttattgtatcgccatcacattattttttattgaccatatttagcgtatttccgcgtgacacatttcacacttatccaaccattctccgcctataaaacgctcaacgactgattgttttatcaccacggagacgccaatgaccttttctgtgcaggaaacgcttttttctttactgcggctaaacgggatttcaggacatgaaagcagtattgcaaacgttatgcagcacgcgttcgaacagcaggccaaagacgtctggcgggatcgcttaggtaatgtcgtcgcccgttatggcagcgataaatccgacgcgcttcgcctgatgatttttgcgcatatggatgaagtgggttttatggtacgcaagatcgaaccctccggttttttacgttttgaacgcgtgggcggcccggcgcaaattactatgcccggttcgattgtgacgcttgccggatgttcaggcgatatcatgggctgtatcggtattaaagcatatcacttcgcgaagggtgacgagcgcacccagccacccgcgctcgataaactctggattgatatcggcgcaaaagataaagcggatgccgaacgaatgggtattcaggtggggacgccagtaaccctttacaacccgccgcactgtctgggcaacgacctggtgtgcagtaaggcgctggatgacaggctggggtgtacggcgctactgggcgtcgccgaggccctcgcctccacaccgcttgatatcgcggtattcctggtcgcgtcggtacaggaagagttcaatattcgcgggattgttcccgttttacgacgcgtgcgccccgacctggcgattggtattgatatcaccccctcctgcgacacgcctgacctgcaggattactcggatgtgcgggtcaaccacggcgtcggcatcacctgtctgaactatcacggacgcggtacgttggcgggactgattacgccgccgcgtttgctgcggatgctggagaccaccgcgcacgaaaataatattcccgtacagcgtgaagtcgcgccaggcgtcatcaccgaaacaggctacattcaggttgaactggacggtattccctgcgccagtctttctattccctgccgctatacccactcgccagccgaagtcgccagcctgcgcgacctggctgattgtatccgtttactgactgcgctggccaatatgtcgccagaacagtttcccattgaccctgaaacaggcgctacacaagaggcacgaccatgatgaaaaagatccttgtggcatgtggtaccggcatgtcgacatcaaccatgattgcacaaaaactgcaggactttcttgcggagcaaggcattgcggcaaccacggcgcaatgttgtctgaatgagatcccgttgaactgtaacggtatggatctcatcgtaacgtccatgcgtacgcacagtgactatggcatcccgacgctcaacggcgccgccctgctgacaggcatcaacgacgacgcattaaaacaagaaatcaaggcgctgttaacacaataaagggggcattatgtttgattacatcctgtctctcggcggcaccgtctttgtgcccatcattatgattatcatcggcttaatctttcgtattccctggctgcaggcggtgaaagcgggggtgacggtcggcatcggttttgtcggcatggggctggtgatcgtcatggcgatcgacagtctcagtccgccgattaaagtgatgattgagcgttttggcctgacgctgcatgtgtttgacgtcggcgccgggcccgcatccggcgtcggctatgcgacggccatcggcgcgatgatcattcccgttatctttctgctcaacgtcggtatgctggtgactcgtctgaccaaaaccatgaacgttgatatttataactactggcactacgccattaccggaacggtcgtccagttgatgaccggcagtctgatttatggcgtactgggcgcgatttgccatgccgccttgtcgttgaaaatggccgactggacgacgaaacgggtacagaacattgtgggtctggaagggatttctattccgcaagggtatggctccagctccgtgccgttgttcgtattgctggatgcgatatacgaaaaaataccgtttatgaaaggacgcaatattgacgctcaggagatccaaaaacggtatgggatggtcggcgacccggtgatcattggcgttgttctcgggctgatcttcggacttgctgcaggcgaaggctttaaagggtgcgcaaccttaatgattaccgtggcggcgattatggtgctgtttccgcgcatgattcgccttatcgttgagggattaatgcccatttccgacggcgcgcgtaagttcttccagaaacactttaaagggcgcgaagtctttatcggtctggataccgcagtgacgttaggccacccgaccaccatcgcggttggactgctgttaattcccatcatgttaattctggcgagcatactgccgggcaataaagtcctgccgctggctgatttaccggtcgcgccattttttatctgcatggccacagttattcatcgcggcgatctgattcgtactctgctcagcggcatcattgtcatgattaccgttttgctgatcgccacccagttcgcgccgtactttaccgatatggcgctcaaaggcggctttagcttcgccgctgaaaacgcgcaaattaccgcgctgtcggtgggaaatatgtttggctggtcaatatctgaattgatgtcgctgggcatgattggtgtggttattgtggtcggcattgtcgccagcatcatacttgtcttacgtaaacgtgaactaccggaataaggagcaacccagaatgagttggctaaaagaggtaataggaacagaaaaagccgttatcgccatgtgccatttacgggcgctgccgggcgatcccgggttcgataccaggaaaggcatgaactgggtaattgaccgcgcccatgacgatttaatggcgctacaaaatggcggcgtggatgcggtgatgttctccaacgaatttagtctgccttatttaacgaaagtcagaccggaaacgactgccgcgatggcacgaatcatcggtcagttaatgagtgaaattcgcgtaccgtttggggtaaacgtgttgtgggaccctgtggcctcttttgatttggcgatggcgaccgacgcaaaatttattcgcgaaattttcaccggtgcttacgccagcgattttggcgtctgggatacgaatgtcggcgaaactattcgccatcagcatcgcatcggcgcaggccacgtgaaaacgctgtttaacatcgtgccggaagcggcggtgtatctgggaaaccgagatgtctgttcaattgcgaaatcgaccgtatttaacaataaccccgatgccctgtgcgtctcggggctgacggcgggcgcccgcacggatagcgccatactgaagcgggtaaaagataccgttcccgacacggtcgtgctggcgaataccggggtgtgtctggaaaacgtcgaggagcagctctgcattgccgacggatgcgtaacggcaaccacgtttaaaaaagacggcgtcttcgccaactttgtcgaccaggcgcgcgtggcgaagtttatggagaaagtacgccatatccgacaataaaatggggataagcaaaacgcttatcccctgcagagagcgataactcttctgccgatctccgtcgccttcgccaaaagacacgccggggatcggtttcagagtaacccgaaccggcaaggagtcaacgatcgatgattaatgatgttaagtgggttcaggcgcaacgccatgccagcgactggcgacacgcgctggatatcgccgttcgtccgctgattaccttcggcgcggcggccccctgctacctggacggtattattgagaacacccttaaatgggggccatattatcttatcgcgccggggattgcgctgccccatgccagaccagagcaaggcgccaaccataatcaaatcagcgtcactacgctatcaacgccggtcgctttcggcaatgcggattgcgatcccatctggctgttgctttgcgccagcgccacggatgccgaagcacatattcgcaccattcaacgcatcagccagtggctcgactcgccggaaagcgtcgcgatgttgcaagatgcgccaaatgatgccgcgcttttcgcgcaattaaccgcattgcgctgatgaaggttccgatgatcctgcacccttcactggcctccgccgatccgctgcgctatgccgaggcgttgaccgctttacacgatgcgcctctcggctcgctgcatctggatatcgaagataccagtttcatcaacaatattaccttcggtatgaaaaccattcaggcggtcgcgcaatactctcgccatccgctctcatttcacctgatggtttcatcaccgcaacgctggttaccctggcttgcagctatccgccccggctggattttcattcatgccgaaagcgtgcaaaacccctcggagattctggcggatattcgcgctatcggggcgaaagcaggactggcgcttaacccggcaacaccgctattgccttatcgttatctggcattgcaactggatgcgctgatgatcatgaccagcgaacccgacgggcgcgggcaacaatttattgccgcgatgtgtgaaaaagtgagccagagcagagagcatttccctgctgcggaatgctgggcggacggcggtattacacttcgcgccgcacggctgcttgccgccgcaggcgcccagcatctggtgattggccgggcgttgttcacgacggcgaactatgatgtgacattgtcacaattcaccgcgctataaaggagtcatatgctgatgagccaacagcgccccgaccgtatcaaacagatgttgcattacctttggcaacacaggcacctctcaacacaacaagctattgagctttttggctatgcagaggcaaccgtgcgccgggattttcactatatcgccagccgttatcccggtatggttcgcggccatggttgtattgactttgacgacagtacggaagataaagaatatgttttcgacgttaagcggacgttacaaagcgaggcgaaacgcgaaattgccgccctcgcccgcacgttcatcaaggatggagactgcttttttctcgactctggctccacctgtctggaactggcaaaatgtctggtcgacgccaaagtaaaagtcatttgcaatgacatcaaaatcgctaacgaactgggtggcttcccacacgtagagagctacattattggcggactgattcgccccggctacttttcggtgggcgagagtctggcgctggagatgattaacgcctttgccgttgaacgcgcctttatctcttgcgatgcgctgtcgattgaaacgggcatcaccaacgctaccatgtttgaagtaggcgtcaaaacgcgcattattcagcgctcacgcgaggtcatattgatggccgatcattcaaagtttgatactgtagaaccccatgcggtggcgacgctgtcctgtattactaccattcttagcgacagtgcgctcccgtctgctatcgcccgacgttatcagcaggcgggatgccgtctcatcatgtcagacccctcatcaggagcgcgttaatggacatcaggcaaatgaacaaaacccatctggagcactggcgcggattgcgaaaacagctctggcctggtcacccggatgacgcccatctggcggacggcgaagaaattctgcaagccgaacatctggcatcatttattgcgatggcagacggggtggcgattggctttgcggatgcctcaatccgccacgattatgtcaatggctgtgacagttcgcccgtggttttccttgaaggtatttttgttctcccctcgttccgtcaacgcggcttagcgaaacaattgatagcagcagtgcaacgatggggaacgaataaagggtgtcgggaaatggcttccgatacctcgccggaaaatacaatttcacagaaagttcacctggcgttaggatttgaggaaacagagcgcgtcattttctaccgaaagcgttgtcgaggaaaatcacacaggaaaaggtcgggtataatacccgacctctatattactgtattactgtggcagatctttttcagttaacaagcgtgtcgttttcacttgttcaatattcctggcgccacccaacatcatgttaattgtcagctctttgtttagctgttcaatcactgatgccacaccctgagcgccgccaagattaagaccgtataatacaggtcggccaaccgccacaatatccgccccgctggctaacgccttgaatacgtgcgaaccacggcgtactccactgtcaaaaataacaggcactcgcttgttgacgacttttgcaatcgcaggaagcatatcgaatgaggacggcccgctgtctaattgacggccaccatgattagaaacccatattcctgcggccccagcctggatagcaatttcagcatcctccggcgactgaatgccttttacaataaccggcagaccggaaatacgatgtacataggcaatatcctccggcgtaaaggcttgtttagcctgcgcgtaaatttcacttatccctgcccctttgccggtttttgaaccatcgtcatttttcctggcgaacatttccaggtttgcaaaactcagcgggaactggaagttatttttaatatcttcttcccgataaccgccgacaggtgaatctacggtcagaataatcgctttagcgccatgttttaccgcttgtgcaagaataaattcgttaaattgattattcttactcatataaagctggaagaagaacgggtttttcccggaaacgttagccacctcttcgatggtcttgttgccataagtgctcaacgagaaaatcgaaccgacctgcgccatgcctttcgccgtcgccaactctccggaggcgtgggccaggccctgcgccgccatcggtgcctggattataggcgttttaagcggaatacccagtagctgcgttgataaatcgatctcttttaactcaatgccctgtaatacgcgcggcataatatattttttgtcaaagctttcggtgttgctgcgaaggttattctcatcttcggctccaccgcgaatataaccaaatgcccctttctccattctggcctgaacgcgcgcttccagagaggctacgttcgtcatttttattgctttttcgtccgtgctggctttgtactcttcagcataagccaggcctgatgttgccaacattgccagcgaggccactacccgaatgaggtgatgagttttcatcattattccttttattgcttaaccgcttctgcctggatttttatatcgacaactttcgtcatccccatatcgaccagataatctacaccccactgggtgcgatctatttgcgtgacaaaatcaccaccgcaaacctgcgccttgaatatcgggctcatataacagccaaacttggtggtggttaaggtgacgggcttagttactcccttcattgttaacaaaccgtcaatagaaactggtttattatcttcaaaatgccattttgtcgatttaaatactatttctggatatttttccgcatccaaaatatcgctactgcgaatatggttatcaaacgcatccaccccggtatttaaggcgctcacgggaatcgtcacacgcatctctgcgacttgcttttccggctgatatttcagttcgccgctaatagcataaaacccgccatgattggttgaggtctggaaacgatcgatattaaataccgcattggtatgcgtattatcaaatttatatacatctgcatgagcagcacttaataaacccagagacaggagagcaccaagaaaactctttttcattatattcactttatatcttaaataaggtgaagctatcttaatgtcccctgtccgcaggatcgagagggataaacaggaaggactgttgcaaaaatagaacgatgaaaaggccgtgtcacaaaaacagcggctcacgaatgggtttatgtcatggcaatttccgcaacctgtaccgcctttgtggcggtacagaaggcaaactgactaacgcatgatacgatcgtcgacataacggcgcttatccggcgcgggcgggaaatactgatacagccaggtttcgctgatagcctccccctggcagcgcaggaacatacgcatatccaccggtgccgtagaatccgaggtcggataccagtcaaactggatacgataaccgtcgaaaggctctacgtagaggatctcaacctgcttcgcctcaccgctggagagcgtaattaccggctcaatgccttttggcgcggccgctttcagatcgccgccgacaaaatcaatagcaaaacggcgtgcccatttatccgggtaatgttcgcccggcgcccagccttcgggaaagccgcccatccctgtacgggtcgccatgacccgcgcaagcggcgattgtaccggcggctgcgcgctccagtacaaacgataattaaacgccagcgtatccccggctttgatcgctttttccggctgccagaaacagaccacattatccagagtttcgccagtggttgggatctccatcaggctaaccgcgcctttcccccacttactgcgcggctccacccacaggctcggacgtttgttgtaccagcccatgacatcctgataatgcgagaaatcgcgatcgagttgcagcaggccgaacccttttgggttatcgtccatatatgcgttgaactgtaatttctgaggattattcagcgggcggcaaatccactcgccgttaccccgccacatcgccagccgatcggaatcgtgaatttgcggatgaatggtgtcgcatacccggcgttcattattcccacagctaaacatactggtcatcggcgcaatgccaagttgctttatatctttacgggcgtagagatggttttctacatccatgatcacctgcgttttttcgcaatggatcacaaacttatacgcgcccgtcacgctggcgctgtccagcagagcgtaaacggtaaacgtagtatcgcccggcttcgcggtgtcaaaccagaatgcggtgaagtcagggaactcttcctgaccgtcagtataggtatctatcgccagcccgcgagccgacaggccatactgataagtatcatctaccgcccggaaataactggcgcccaggaaggagacgacatcgcgccgcgccagttccggcgctttaaagacacggaaaccggcgaaaccgagatcgctctgcccttccagttgcgtcgtatcaacgccggcatcgttgtatttaaacagttccgggcgaaaatgaatctcgcgagcaagatgcgtcgtcgtatcaacggaaaacatgcgtacgcgacgacggaagcccatccctacgtggaaaaactgaatatcgagctgccggttggcaacaccgttccagagtgaatgcgccgcgtcatactgaatgctgttataggcctgcggcgtcagattggcgagcgtatccggcaagggtcccggcgcgccaccccagggctttttcgctaacgcctgggccattgattgcagaccagcaaaatcaaaacggacaattttaccatccgcaatatcggattccgcggcaaacgccgcctgagaaaagagtgaagcaataccgctggaaccgcacacggcggccattgccattgaacctttaataaatcgtctacgattcatacctgaaaatgagtccttctggtcttgtgaatggtcccgcgctggttttttcagcagcaagaatgtgcccgtttctgaccgctcactctagacaaaattcattaataatccaattgttggtcgcctggaaactgtgcaaaagcgtaaatattttatgtcgataagaaccgaccgaatcggatgtaaacctcacgcagcattcttcaggttatgaaaagtttattccagactaacgtgatgtttcatgactcgtttaaacagcgccagacgcgcacgcataaagcggttttccactttaaaaccggcaagtttgttcagcccaatccgcaacagacgatctcgcccccgaatgctggcgggccagcgaaccgggccgtgcagcacgtcgcgcgtgcggctggcatgacgagcgaaattcacccagtaatccgccacctgcgaggcaaaggccaggtcattctcattcacataatggcatgtgggctcagcccgcgttaacgtatcgaatacatacggtatttcattgccatgacaggcgctattcgcgtaggtgttatgctccgcctcggcgacataatcaaaccagtaacgccagcacggttcgccgatccgcttctgcgcttgcatgacgacataacccaacgtggtaaataccatatcccgacagacctgccgccctagcgcttcgtcgcctttcactccaggataaagcagccggattaaccccaagccaacacgccgctcacggcgcattttttgaatttgaccggcaatatcgacgccaaaaacggccaatacgctggcttcatcgctattcgagccgatcatcaccggtattggatgctgtttcgccgcaaagaaggtttccagcatcggatgcggcagcacgacgtcgccggaaatcggcgtcggcgcaattttaaaaggcgcgtccagcggccaaaacgtctctgccggtaaagcgcgtagctgttcggcagtggcatgggctaaaccaagatgttccgccagcgcaacgcctttttttagcgccacctcgcggggcgtatccggcagcgtataaccactctgaataatcgctttatgaaaaagccccttcgccaacggcgaagccatcaacgacagcacgctgcgggcgccggcggattcgccaaataacgtcacattctgcgtatcgccgccaaatgcggcaatattgtcctgcacccaacgcagcgcagcgatttgatcgagtaaagcgaaattatgaatacactccgccccttcgccttccagcgccggatgcgcgaaaaagcccagatggccaagccgataattgaccgtcaccacgatcgcgccgcgcttcgccagcgcttgaccgtcatagggcggcaaactccccgcgccaatggtgtaaccgccgccgtgtagccagaccatgaccggcaacggttcatgacgcacggcgggagcccagacgttcagatagagacagtcttcggaaaaatttcccggatcgccgccgccgagttcgcgacaccaggtaatatcctgccaactggcgcaggagaaacaatccgcctggcgcacatcctgccagggcgtaacaggctgcggcgcacgccagcgtagctcccctgttggcggcgcggcataaggtataccgcgccagatatggatttcttcctgtacgacgcccacgattttaccgtgacgcgtcgccaccagcgggatggagggattcaacataacgccttccttttacagtatcctcacagcctgtgaagcttaccgcttttaaagcagaccgcaacggcgtttactgcgttcttccgcttcctgatataacgaaaattcatcccgtacagcacatcccagcgcctgttcaaaggcgtcgcggctggcattgccgtggcttctggccagcgtttcatttcccaaattcgactgaaaaatgccggctgcgctgaccggaagaaaatcttcataggtaatcggctgcgcgatcacccaaccgcgctcaataagcggctgcggatcgtcgccaggatggatcgcctgacgatgcgcctcgccggaaggcgttaagcgataacggaaccaggcaagcccctgcaggcgaagcagaaattcgctatccggaaaggcgttaaagacctcccgcaaatggagttgatgcgtgaagttgtccttacccgttcccgccttgtgcaacagttcgtcatataatcgacgaccttttggcgtcagcgcgacgccacgttgctcaatttcgccgaagcgcgccgtgtgcgtaccctgcttttcatcaacgaagagcacctgctcttccagagctttgaaactggtttgccgcaacagaataggcacttcgcggcgaggcggaccttcgataagaattttaggcgtaatgccgcactccggcatcatggcctgtacccggtcgatatccagagtacgcggcgtcagatggttaatgtggcatcccggaaaacagaccacgtcggcaattaaacgatgctcacgatgcaggctgcggtacgtttcttcatcaacggtagcctgacgatgccagcgaaaagtctccagcgtttcacggacgaactcttcggcctgagcagcactaaaaccgccctgctcgtcgtactcatccagcaattgtcggcagcgcgatgtaaaaatatcacgctgcgataagatttccgccgcccgctggcgtaatgccgcgttttcaatgagctccaggcgtaatagcgaagtgaacatgcgaaagggattacgcgagagcgaagcctcgtcaatgggacgaaatgccgtggagtgcacaggcacgcccgcctgagagagatcgtaataacttactgggtacatccccatgatggcgaatatccgacgcaagttcccggggctaaagaccctcagctagatatatgtccgcaatacgtcttcaatgactttgtccatccaacccaggaagtccatcattgttttgccacaatgttagaaagttttatagctcatcattattccactgaataatgttccatcggctgcggtacgccttgagcaaaacaccgctcaatatcatagtgccggtgacatgaaaatatgaggttgtctttgctgccggttggtcaataagtgatccatactctatgttcagtaggacaaaaatggatagagtcgatagatcgccaccgtaactacaatactcactatcacactggcgataaagtatgttttgaatggctgcttttgcgttttatgacggaaaagttgttgaccaacaatcgcaccaggccacccaccgacaaccccaaacaccaacaaagtggattccggcactctgcgccaggttttacgtgccgccgttttatctacaccgtagatcgccagcgttagcacattggcgagcaggaaccacatcgcgacgggatacgatgtaaaaatgcttccgaccgcagcagagatcaggagtaaataacaaaagcggttaagatacatattattatgtcatagcaatgattagggacatcggagcccattatacgcgatacatgcgcctatgtgatgcagaattttcttttcattcagccaacgagtcatcgagtcatcgaggattcatttttaattaccatggtaatcataaggtaattaacgtgttgtgaacacgattaaaatgggtaaagccaccaaaaatgttaccaccttaaccattgccaggataacttaatggagagccctctttattgctgtttgttatccggttggcagtctcagttttggatttatttatcgtatttatgtttattacataagatgtacgatgttaatttgagaattttatcccgacaaccgcatatattaagatatttctgaattaagattattatcgattaaaacaagttaacgttttgataaacataacaacatcgtcagaactcctgatttgttgtcgtttgttcataggataaataatttatatgcttgcaaatatagatagcacgcaaatcaatttagctcagaaaatgtatttgacaagcaaagataagtctttatattggccctggatagagtggtaagatgatacttagagacattaaatacaccgtcactgaagcatttatctgcttatcatgtaaatatgtatgcgtaaatggagcataaactatgtccagtatactaatgtctatggtatctttacattttcacctttcattgggtcgctgcactcatatccagttgatatctcatggtatattcaatccattccctttgatgattcctgtcaaacctcctgattaaattagttaacagcgatggaatacataacgttaagtactttacgcctgcaaatgtcaggttcacgctctaatgcttaatttataatacgtattaccttaccacaggaaatagatagcatgttatccaaaaaaattggcttatcgatgatagtgttgggaataatgtcgtcttcagcttttgctgatagcatcgttgaagggagaacactcaatgtcgcagtatcaccggcctctccccctatgttatttaaaagtgctgatggcaaattgcaggggatagatctggagcttttttcgtcttactgtcagtcacggcattgtaagctaaacatcaccgaatatgcctgggatggaatgcttggcgcagtggcgagtggtcaggctgatgtagcattttcgggaatttcaatcacagataaacgtaagaaagttattgatttttctgaaccttattacatcaactctttttatctggtcagtatggccaatcataaaataacgctcaataacctcaatgaattaaatcaatattctattggataccctcgaggaatggcttactccgaccttatcaaaaacgatctggagcccaaaggatactactcgttaagtaaagtaaaattatatccaacctataacgagacgatgactgatctaaaaaatggtaatcttgatctggcttttatagaagagccggtttactttaccttcaaaaataagaaaaaaatgccgatagaaagtcgttatgttttcaagaatgttgatcagcttggcattgcctttaagaaaggctctcccgtgcgcgatgattttaacttatggcttaaagagcaagggccacaaaaaatatctggcatcgttgataactggatgaaatagtaagctatgtcatcaggtaatatgctggctatcttttatttcctattggaagggattggtaatacgctgcttgtaacctttacctgttttctctcagcgtttttgaccgggcttacagtcgccgtattacggcgactatccccccttccactacagaagatactcgacgtactggtctttattcttcggggaattccaatacttattgctgtttttcttgtttattttggattgccatcgattggcatatatgtttcacctctggtggccatgaacctcagcgtcggcttaatcagcgggagttatcttgccgaggtgttcagaggggcgcttaaattagttgagccattcgaaataacggtagcgaaagtagcaggaatgcgtcaattacaggttataataaatattgaactgccacagatgttgcgattttctgtgcccggtattatcaatgagttttcttctgtattaaaagcgacgccctttgcttatactgtaggcatcgctgaaataacgaagcaggcaatgtcactgacagccatcacgctgaacgggttacagatctatacccttgccggggtattatatttcattatttataaagcatttactcttctggccggagtgtttgagaaaaaatatcgcatcagttgaaacataaaaatagaggtgatactcatggctttactggaactaaaagagataagtaaggaatattcaggaaaaaaggttcttgatgcggttagtttgaaaattcaatcgggagacatgaaagtagtcatggggccatcgggttgtggaaaaacgacgcttttacgctgtctgcttcgattagaagaacctgattatggcgatatttattttcacggggaaaatatttacgacaaagaatttactattcttgagttcagaaaaaaagttggttgtgtcttccagaattacgcattgtatcgccatcttaacgtcatggataatattacccttgccctatgtaaagtgtttgggatgccgggacaactagcccgggagaaagccttacatgagctacaaaaacttgatatggtctcgcatagcgcgaaatacccttcgcaattatcgggtggccagcaacagcgcgtcgccctggcccgtacaatggtcaccgacccagaactcattatttttgatgagccgacgtctgcgcttgatccgctcatgactcgtgaagtcggaatgttgatcaagcaacttcacgacaatggcgtcactatattatgcgtcactcatgatattcgcctcgccagattactaagcgataacgtaacgtttcttaatcatggcaagattcgtgcagaaggcgcttttaccgatcttgccttacgagaaacggatccagatatccactgtttttttagcgaggcacaacgatgatcgctggctggtctcttttctttaatgacctgactgaacaactgccacttgttgtggacggtattaaagaaacctgtaaacttgcgctgattgtttccatcaccggttttttgtggggaattattattttctttctgagcctgagccatcgccccgtggtaaaagccataactcgactgtacatggatttctttatcggtacgccactcattcttattctgtttgttatctattatggtttacctcaatctggcattcacctgtcctcttttaccgtggcggttacaggttttaccttgaatgtcggcgcatataatgccgcgtacatgacaacggcctataacgcattgaataagtatgaaacggaggcagcagtcgttcaggggttgaacaaacggcaggtctttttgtggattatactgcctcaggtattgctgtcttccattccagccttaacgaatcaggtgattaataaccttaaagacagcaccatcgtttttcttatccaatatactgagtttttcgcgcgaattcaggaggttgctgcaaccagctttaaattcttccatgcttacctttttgccgccatagtgtaccttattggcgttacctttattgtcggtttgacccggtttttagagcatagactgcttcgccattacggtcaggattactgagttgtactgcactattctgattaattcaccgctgacattatcaaagttatttttatttagtgttggttaagattttaaccttcattattgcgttaggtgtccattctggtctaagtcttactccattgaggatattatggcgctaccacaactatccatatggcagcccggcgatgggttaagaaaaataaagtataaatatcatgtttgtctcattgttatattctccgtccttatacggttgctgtttttaactgaccgctacctttggtgtgacgaagcgtccagcgtgctgattagtcgacatagcgtagataatctgctcttccatgccgcttttgacgtgcatcccccgctttattatctgttactgcatgactggatcatattattgggtgatagcattgcagcggtacgctctctcagtctactctttgggatcctgacagttgtgctggttatcgcgcttacgcgatggctggcaaatgaacgtacagccttattggcgggatggttcgccgccctgatgccgatggcagttcattacagtcaagaaacgcgcatgtacgcgttaatgggaatgctaacgctcgctgccgcgttagcattgatgatgtggataaaaacacccacccataatcgctatcttgtcgcgtatgctttacttatgacgttcagcttttacacccattatttcaccctatttacacttattgcccactggatcgcagtaacaatattatcctgccaaagccataaaacggcctgctaccttaaacttcctggctggtggtttgctaacctggcgattgctgtcgcttatctcccctggttgcccgtattgtttaatttactgactcatctggcgcagttgagagccggtaatgatatcggttggattccccccgtaacatggcgtgacctgcctgcgatgtactggcatttttttaccggaaacaacggacagggttttccgtcgttcattctgtggctggctgtgggaggttttatcggtactgtggggcgaatatctttatacaacggagaatatgaaagatatcagctgatattattttgtaatctggtcatccctgtaatgctggtcttcatcatttcctggtggatgccgttatttatcgatcgttatttcttcttctcatcgctgagcattcctcccctgctcgcggtattacttacccgcgcaaaaaaagcggtttgtggcttctggtttatcttattcaccttattattcggctatggttcatatcataataaccctgagcacatagacgagtttaaaccactggtaaactatattaatacccgtcaccagcctaatgatgccgtggtagtcagtaaaatgttcgattatttaagttatgtgtattataataagcgagattatcgtacgtttctttatacaccacctaacgcacacggaacatcaggaagaccgaatgcctatggctttggttcactgttttatgcgcaagccgatcagacatatattgatactctgacaacgctttcaaaaagttaccatcgtgtctggttggtaagcggcggtaacttcagtcaggattaccccttgccgtcagaatggcaaaatatcgcaaaattcagaagtggtagatttcaggtacaattatttgtaataccaactcaacaggcgcgtcaaatgcaatgattaccgttttctatccagtgcagtgataaacagtactgccactgccagaccgcctaaaagtaaggtccagccaaacgcttcaaaaacctcaatcatatcgcctccaggtaggtgatattaaataaagatggctatctcagcgtaacatttaaaatatcaattaatgtgcaataatcgctttatgtgtatgaataaatattgttcctcatgcatttaattgcattgctattatcataaggcttaatatatttatattaacgattattaattatcagcttataataatatgactgtccaattcatttatcagctattattatcctctatattctttaagatagccgtttaattaataatatcgcctttattcatcgcattaaattactcactcacctgattaatgcttgcctaacgattacttcgttgttttaattccagcgcgaaattatttaatgagagaacaatgaagcatacacaacaatcaggcgcaaaagtctataacccattcacgcttagcttatatgactggtgggtactcaatatctcaaacaaatatgcctggaagtgtcctactgatacgcgactacttcctttcttcctgcatcacatgggcgagactcacctggatattggcgtaggtacaggttattacctgaaacatgcacctgcgactcatgccatttcgctgatggatttaaatccggatagcctgaaaatagccgccagccgagtgggtaatacgaaaatccgcgccacactacaacacgatgttttcgacacgttcccggcggactggcacgggcgcttcgattccgtttcgatgtactatcttctgcactgcttacccggtgagatgacaacaaaagcgaaggcaattaaaaatgccggtatggcgctaaaacccggcggcacactttttggcgccacgattctgggcaaagaggttcctcacaatgcttttggtaagaaattaatggctgtttataacaagaaaggaatattcagtaataccaatgattcagccgatacgttacgcagcgtgttggacgaacatttcgctaaggtgactttggagcaacatggcgccgttgcgctattttccgccactatgccacgttcattgtaggtgtaggcacttccgggcggtcggcagcgcgatcatgtgggtttaacccgttgattaaacattggattacggaatagtaattgtttattttatttgtcatacaaataagtataatacccgcttccgatgtagacccgtcctccttcgcctgcgtcacgggtcctggttagacgcaggcgttttctgtatggaatacgccatcccctctgatagatgccttgtttgcctaaagcagttaaccccgcctgtagcaaacgtcatacaggacggtcagttacgcttacgcggcatcatccgtaacagcgtattgtctttccagaaatagtgatgcatcaaagcagcgatggcatgaagtccaataacaaaatagcccagattcgccagcgtgacgtgccaggatttcagcatatctacgcgttcaaagttagcttcggcggcatgcggcatagtaatgccaaatgcgaaccagggattgccgcggttatacatcatgaccagaccaataacaggcagcacgataaataacaggtaaatcaccagatgtcctaaatgcgccattccggtcatcatcggttttggacgaggaacaatgggcggcgtgggatatttcagccgaataatcaagcgcgccaccattaaaagcaaaatagtgataccacatgaaacatgcgtcatattaaactagggccgataactacgcggcgcaaaaccgcgtagctccatcgcggcgtaagccacaataaccagaaaaaagactaaccagtgaataccaatttgcaggccggaatacttattgcccatagcgcgtcctgaatgaaaaccgtaaagcgacaacataaccagcttttataaataattcatcaaatttatgaaatggtggtcgcacttgcccgttcaccctcgcaaacgggcgatttttagcgtaaagctctctgttctaacgcactgcgcagcgtcgtatctgcctgcaatacctgccatgccttttcaatatcgcgtgggatatcaacgtgaatgataaaatctttaccacgcggtccataccctgtttcatcgtcacgcaaacgtggcagctcgccggcaatcagagacagataacgctccaccgtccagatgccctcttcaacgttggcaaaacgtgtaccgccgttaaggtggcgcagtaccggaacaaaaccaggaaaactcagccagcgcggcgcatcggtgtcgtcgtttgtcacgcgccgaaacgccgcgatagtgcgccgctgcatggtggggtcttgcacaacgatagccgtgttaatgttttctttcgcctgacggatcagtgcgcaggagaaacgggcattttcgccgcaattagttgaccgatcttccagccaaattttctcagccggaatatgccagaactggttcgcgatatccgcgaggatagcggcttcagcgcgtccggttgtgcgaatagtatggtagcgcggatgccgggc

(The sequence listing continues in the following parts.)

What is claimed is:

1. A transgenic *Salmonella typhi* Ty21a comprising a heterologous *Shigella sonnei* O-antigen biosynthetic gene region and a heterologous acid resistance biosynthetic gene system comprising one or more heterologous *Shigella* acid resistance enzymes, wherein said heterologous *Shigella sonnei* O-antigen biosynthetic gene region and said heterologous acid resistance biosynthetic gene system both being integrated into the *Salmonella typhi* Ty21a chromosome, wherein said heterologous *Shigella sonnei* O-antigen biosynthetic gene region comprises a wzz gene, which comprises (i) a DNA sequence that shares at least 95% sequence identity with the DNA sequence of nucleic acids 4,511,904 to 4,513,010 of SEQ ID NO: 4; or (ii) the DNA sequence of nucleic acids 4,511,904 to 4,513,010 of SEQ ID NO: 4, and wherein:

a. a heterologous *Shigella sonnei* 0-antigen is stably expressed;

b. one or more heterologous *Shigella* acid resistance enzymes comprising a YbaS gene are stably expressed;

c. said transgenic *Salmonella typhi* Ty21a is more acid stable at pH 2.5 than *Salmonella typhi* Ty21a without the integrated acid resistance biosynthetic gene system;

d. an immune response is elicited against virulent *Shigella sonnei* challenge; and e. an immune response is elicited against virulent *Salmonella typhi* challenge.

2. The transgenic Ty21a of claim 1, wherein said heterologous *Shigella sonnei* 0-antigen biosynthetic gene region comprises (i) a DNA sequence that shares at least 95% sequence identity with the DNA sequence of nucleic acids 4,500,076 to 4,513,461 of SEQ ID NO: 4; or (ii) the DNA sequence of nucleic acids 4,500,076 to 4,513,461 of SEQ ID NO: 4.

3. The transgenic Ty21a of claim 2, wherein the YbaS gene comprises (i) a DNA sequence that shares at least 95% sequence identity with the DNA sequence of nucleic acids 4,503,240 to 4,504,172 of SEQ ID NO: 1; or (ii) the DNA sequence of nucleic acids 4,503,240 to 4,504,172 of SEQ ID NO: 1.

4. The transgenic Ty21a of claim 3, additionally comprising an O-antigen biosynthetic gene region from a bacterial strain selected from the group consisting of: *Shigella dysenteriae, Shigella flexneri, Shigella boydii, Escherichia coli, Salmonela enterica* serovars, *Vibrio cholera* serotypes, *Enterobacter* species, *Yersinia* species, and *Pseudomonas* species.

5. A composition comprising the transgenic Ty21a of claim 4 and a carrier.

6. A vaccine comprising the composition of claim 5 which is suitable for oral administration.

7. The vaccine of claim 6, wherein administration of said vaccine to a human population reduces the incidence of shigellosis in said human population subsequently exposed to pathogenic *Shigella sonnei.*

8. The vaccine of claim 6, wherein administration of said vaccine to a human population reduces the incidence of typhoid fever in said human population subsequently exposed to pathogenic *S. typhi.*

9. The vaccine of claim 6, wherein administration of said vaccine to a human population reduces the incidence of both shigellosis and typhoid fever in said human population subsequently exposed to both pathogenic *Shigella sonnei* and pathogenic *S. typhi.*

10. The transgenic Ty21a of claim 1, wherein the one or more heterologous *Shigella* acid resistance enzymes comprise GadA and GadC genes.

11. The transgenic Ty21a of claim 1, wherein the one or more heterologous *Shigella* acid resistance enzymes comprise GadB and GadC genes.

12. The transgenic Ty21a of claim 1, wherein the one or more heterologous *Shigella* acid resistance enzymes comprise GadA, GadB, and GadC genes.

* * * * *